United States Patent
Bernett et al.

(10) Patent No.: US 11,851,466 B2
(45) Date of Patent: Dec. 26, 2023

(54) TARGETED IL-12 HETERODIMERIC FC-FUSION PROTEINS

(71) Applicant: Xencor, Inc., Pasadena, CA (US)

(72) Inventors: Matthew Bernett, Monrovia, CA (US); John R. Desjarlais, Pasadena, CA (US); Rajat Varma, Hamden, CT (US); Ke Liu, Glendora, CA (US); Rumana Rashid, Temple City, CA (US); Nargess Hassanzadeh-Kiabi, Pasadena, CA (US); Michael Hedvat, Encino, CA (US)

(73) Assignee: Xencor, Inc., Pasadena, CA (US)

( * ) Notice: Subject to any disclaimer, the term of this patent is extended or adjusted under 35 U.S.C. 154(b) by 260 days.

(21) Appl. No.: 17/062,458

(22) Filed: Oct. 2, 2020

(65) Prior Publication Data

US 2021/0355185 A1    Nov. 18, 2021

Related U.S. Application Data

(60) Provisional application No. 63/005,100, filed on Apr. 3, 2020, provisional application No. 62/910,328, filed on Oct. 3, 2019.

(51) Int. Cl.
| | |
|---|---|
| C07K 16/46 | (2006.01) |
| C07K 14/54 | (2006.01) |
| A61P 35/00 | (2006.01) |
| C07K 16/28 | (2006.01) |
| A61K 39/00 | (2006.01) |

(52) U.S. Cl.
CPC .......... *C07K 14/5434* (2013.01); *A61P 35/00* (2018.01); *C07K 16/2818* (2013.01); *C07K 16/2827* (2013.01); *A61K 2039/505* (2013.01); *C07K 2317/622* (2013.01); *C07K 2319/30* (2013.01)

(58) Field of Classification Search
None
See application file for complete search history.

(56) References Cited

U.S. PATENT DOCUMENTS

| | | | |
|---|---|---|---|
| 5,650,492 A | 7/1997 | Gately et al. | |
| 6,617,135 B1 | 9/2003 | Gillies et al. | |
| 7,141,651 B2 | 11/2006 | Gillies et al. | |
| 10,550,185 B2 * | 2/2020 | Bernett | C07K 16/2818 |
| 10,696,722 B2 | 6/2020 | Yong et al. | |

(Continued)

FOREIGN PATENT DOCUMENTS

| | | |
|---|---|---|
| EP | 1418184 | 5/2004 |
| KR | 1 00 827 757 B 1 | 5/2008 |

(Continued)

OTHER PUBLICATIONS

Jones et al., Interleukin 12-Augmented T Cell Proliferation of Peripheral Blood Mononuclear Cells from HIV-Seropositive Individuals Is Associated with Interleukin 12 Receptor b2 Upregulation, AIDS Res. Human Retrovir. 19(4):283-292, 2003.*

(Continued)

*Primary Examiner* — Claire Kaufman

(74) *Attorney, Agent, or Firm* — Christopher J. Betti; Jennifer Patritti Cram; Morgan, Lewis & Bockius, LLP

(57) ABSTRACT

The present invention relates to targeted IL-12 heterodimeric Fc fusion proteins, where the fusion proteins bind to human PD-1 or human PD-L1.

16 Claims, 347 Drawing Sheets

Specification includes a Sequence Listing.

(56) References Cited

U.S. PATENT DOCUMENTS

| | | | |
|---|---|---|---|
| 11,358,999 B2* | 6/2022 | Bernett | C07K 14/5434 |
| 2007/0154453 A1 | 7/2007 | Webster et al. | |
| 2014/0294759 A1* | 10/2014 | Chu | A61P 37/00 |
| | | | 435/69.6 |
| 2017/0247425 A1 | 8/2017 | Ungerechts et al. | |
| 2019/0169252 A1 | 6/2019 | Kim et al. | |
| 2020/0216509 A1 | 7/2020 | Bernett et al. | |

FOREIGN PATENT DOCUMENTS

| | | | |
|---|---|---|---|
| WO | WO1999029732 A2 | 6/1999 | |
| WO | WO2001007081 A1 | 2/2001 | |
| WO | WO2001010912 | 2/2001 | |
| WO | WO2001058957 A2 | 8/2001 | |
| WO | WO2001068802 A2 | 9/2001 | |
| WO | WO2002002143 A2 | 1/2002 | |
| WO | WO2002066514 A2 | 8/2002 | |
| WO | WO2002072605 A2 | 9/2002 | |
| WO | WO2002066514 A3 | 2/2003 | |
| WO | WO2007076933 A1 | 7/2007 | |
| WO | WO2007084364 A2 | 7/2007 | |
| WO | WO2008134879 A1 | 11/2008 | |
| WO | WO2011082301 A2 | 7/2011 | |
| WO | WO2013053775 A1 | 4/2013 | |
| WO | WO2013090296 A1 | 6/2013 | |
| WO | WO2015095249 A1 | 6/2015 | |
| WO | WO2016048903 A1 | 3/2016 | |
| WO | WO2017041739 A1 | 3/2017 | |
| WO | WO-2017055547 A1 * | 4/2017 | A61K 39/39533 |
| WO | WO2017062953 A1 | 4/2017 | |
| WO | WO2018030806 A1 | 2/2018 | |
| WO | WO2018068008 A1 | 4/2018 | |
| WO | WO2018213731 A1 | 11/2018 | |
| WO | WO2019006472 | 1/2019 | |
| WO | WO2019129053 | 7/2019 | |
| WO | WO2020072821 | 4/2020 | |
| WO | WO2020086758 | 4/2020 | |

OTHER PUBLICATIONS

NCBI GenBank Database, Accession 445842.1, Interleukin-12 subunit alpha precursonr [Rattus norvigicus], Retrieved online: <URL:https://www.ncbi.nlm.nih.gov/protein/NP_445842.1>, accessed on Feb. 15, 2023. Dec. 21, 2022.*

NCBI GenBank Database, Accession 3HMX_B, Chain B, interleukin-12 alpha, Retrieved online: <URL:https://www.ncbi.nlm.nih.gov/protein/3HMX_B>, accessed on Feb. 15, 2023, Dec. 1, 2020.*

Peng et al., A Single-Chain IL-12 IgG3 Antibody Fusion Protein Retains Antibody Specificity and IL-12 Bioactivity and Demonstrates Antitumor Activity, Immunol. 163(1):250-258, 1999.*

Wells, Additivity of mutational effects in proteins., Biochemistry 1990, 29, 37, 8509-8517.

Ngo et al. "The Protein Folding Problem and Tertiary Structure Prediction, Chapter 14: Computational Complexity Protein Structure Prediction, and the Levinthal Paradox" pp. 433-440 and 492-495 only, (1994).

Bork, Powers and Pitfalls in Sequence Analysis: The 70% Hurdle., (2000) Genome Research 10:398.

Skolnick et al., From genes to protein structure and function: novel applications of computational approaches in the genomic era., (2000) Trends in Biotech. 18(1): 34.

Doerks et al., Protein annotation: detective work for function prediction., (1998) Trends in Genetics 14(6): 248.

Brenner, Errors in genome annotation., (1999) Trends in Genetics 15(4): 132.

U.S. Appl. No. 16/592,656, 2020-0216509, Published, filed Oct. 3, 2019, Jul. 9, 2020, Bernett et al.

Holscher C: "The power of combinatorial immunology: IL-12 and IL-12-related dimeric cytokines in infectious diseases", Medical Microbiology and Immunology, Springer, Berlin, DE, vol. 193, No. 1, Jun. 27, 2003 (Jun. 27, 2003), pp. 1-17, XP002411766, ISSN: 1432-1831, DOI: 10.1007/S00430-003-0186-X.

Ha et al: "Immunoglobulin Fc Heterodimer Platform Technology: From Design to Applications in Therapeutic Antibodies and Proteins", Frontiers in Immunology, vol. 7, Oct. 6, 2016 (Oct. 6, 2016), pp. 1-16, XP055377975, DOI: 10.3389/fimmu.2016.00394.

Jung et al., Heterodimeric Fc-fused IL12 shows potent antitumor activity by generating memory $CD8^+$ T cells., Oncoimmunology, 2018, vol. 7, No. 7, e1438800 (13 pages).

Fallon et al., Enhanced antitumor effects by combining an IL-12/anti-DNA fusion protein with avelumab, an anti-PD-L1 antibody., Oncotarget, 2017, vol. 8, (No. 13), pp. 20558-20571.

Strauss et al., First-in-Human Phase I Trial of a Tumor-Targeted Cytokine (NHS-IL12) in Subjects with Metastatic Solid Tumors., Clinical Trials: Immunotherapy, Clin Cancer Res; 25(1) Jan. 1, 2019.

Kiefer et al., Immunocytokines and bispecific antibodies: two complementary strategies for the selective activation of immune cells at the tumor site., Immunol Rev Mar. 2016;270(1):178-92. doi: 10.1111/imr.12391.

* cited by examiner

Figure 1A

Human IL-12 subunit alpha (IL-12p35) precursor sequence (SEQ ID NO:1)

```
>sp|P29459
MCPARSLLLVATLVLLDHLSLARNLPVATPDPGMFPCLHHSQNLLRAVSNMLQKARQTLEFYPCTSEEIDHEDIT
KDKTSTVEACLPLELTKNESCLNSRETSFITNGSCLASRKTSFMMALCLSSIYEDLKMYQVEFKTMNAKLLMDPK
RQIFLDQNMLAVIDELMQALNFNSETVPQKSSLEEPDFYKTKIKLCILLHAFRIRAVTIDRVMSYLNAS
```

Human IL-12 subunit alpha (IL-12p35) mature form sequence (SEQ ID NO:2)

```
>sp|P29459|23-219
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS
```

Human IL-12 subunit beta (IL-12p40) precursor sequence (SEQ ID NO:3)

```
>sp|P29460
MCHQQLVISWFSLVFLASPLVAIWELKKDVYVVELDWYPDAPGEMVVLTCDTPEEDGITWTLDQSSEVLGSGKTL
TIQVKEFGDAGQYTCHKGGEVLSHSLLLLHKKEDGIWSTDILKDQKEPKNKTFLRCEAKNYSGRFTCWWLTTIST
DLTFSVKSSRGSSDPQGVTCGAATLSAERVRGDNKEYEYSVECQEDSACPAAEESLPIEVMVDAVHKLKYENYTS
SFFIRDIIKPDPPKNLQLKPLKNSRQVEVSWEYPDTWSTPHSYFSLTFCVQVQGKSKREKKDRVFTDKTSATVIC
RKNASISVRAQDRYYSSSWSEWASVPCS
```

Human IL-12 subunit beta (IL-12p40) mature form sequence (SEQ ID NO:4)

```
>sp|P29460|23-328
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS
```

Human IL-12 receptor subunit beta-1 (IL-12Rβ1) sequence (SEQ ID NO:5)

```
>sp|P42701
MEPLVTWVVPLLFLFLLSRQGAACRTSECCFQDPPYPDADSGSASGPRDLRCYRISSDRYECSWQYEGPTAGVSH
FLRCCLSSGRCCYFAAGSATRLQFSDQAGVSVLYTVTLWVESWARNQTEKSPEVTLQLYNSVKYEPPLGDIKVSK
LAGQLRMEWETPDNQVGAEVQFRHRTPSSPWKLGDCGPQDDDTESCLCPLEMNVAQEFQLRRQLGSQGSSWSKW
SSPVCVPPENPPQPQVRFSVEQLGQDGRRRLTLKEQPTQLELPEGCQGLAPGTEVTYRLQLHMLSCPCKAKATRT
LHLGKMPYLSGAAYNVAVISSNQFGPGLNQTWHIPADTHTEPVALNISVGTNGTTMYWPARAQSMTYCIEWQPVG
QDGGLATCSLTAPQDPDPAGMATYSWSRESGAMGQEKCYYITIFASAHPEKLTWSTVLSTYHFGGNASAAGTPH
HVSVKNHSLDSVSVDWAPSLLSTCPGVLKEYVVRCRDEDSKQVSEHPVQPTETQVTLSGLRAGVAYTVQVRADTA
WLRGVWSQPQRFSIEVQVSDWLIFFASLGSFLSILLVGVLGYLGLNRAARHLCPPLPTPCASSAIEFPGGKETWQ
WINPVDFQEEASLQEALVVEMSWDKGERTEPLEKTELPEGAPELALDTELSLEDGDRCKAKM
```

Figure 1B

Human IL-12 receptor subunit beta-1 (IL-12Rß1), extracellular domain (SEQ ID NO:6)

>sp|P42701|24-545
CRTSECCFQDPPYPDADSGSASGPRDLRCYRISSDRYECSWQYEGPTAGVSHFLRCCLSSGRCCYFAAGSATRLQFS
DQAGVSVLYTVTLWVESWARNQTEKSPEVTLQLYNSVKYEPPLGDIKVSKLAGQLRMEWETPDNQVGAEVQFRHRTP
SSPWKLGDCGPQDDDTESCLCPLEMNVAQEFQLRRRQLGSQGSSWSKWSSPVCVPPENPPQPQVRFSVEQLGQDGRR
RLTLKEQPTQLELPEGCQGLAPGTEVTYRLQHMLSCPCKAKATRTLHLGKMPYLSGAAYNVAVISSNQFGPGLNQT
WHIPADTHTEPVALNISVGTNGTTMYWPARAQSMTYCIEWQPVGQDGGLATCSLTAPQDPDPAGMATYSWSRESGAM
GQEKCYYITIFASAHPEKLTLWSTVLSTYHFGGNASAAGTPHHVSVKNHSLDSVSVDWAPSLLSTCPGVLKEYVVRC
RDEDSKQVSEHPVQPTETQVTLSGLRAGVAYTVQVRADTAWLRGVWSQPQRFSIEVQVSD

Human IL-12 receptor subunit beta-2 (IL-12Rß2) sequence (SEQ ID NO:7)

>sp|Q99665
MAHTFRGCSLAFMFIITWLLIKAKIDACKRGDVTVKPSHVILLGSTVNITCSLKPRQGCFHYSRRNKLILYKFDRRI
NFHHGHSLNSQVTGLPLGTTLFVCKLACINSDEIQICGAEIFVGVAPEQPQNLSCIQKGEQGTVACTWERGRDTHLY
TEYTLQLSGPKNLTWQKQCKDIYCDYLDFGINLTPESPESNFTAKVTAVNSLGSSSSLPSTFTFLDIVRPLPPWDIR
IKFQKASVSRCTLYWRDEGLVLLNRLRYRPSNSRLWNMVNVTKAKGRHDLLDLKPFTEYEFQISSKLHLYKGSWSDW
SESLRAQTPEEEPTGMLDVWYMKRHIDYSRQQISLFWKNLSVSEARGKILHYQVTLQELTGGKAMTQNITGHTSWTT
VIPRTGNWAVAVSAANSKGSSLPTRINIMNLCEAGLLAPRQVSANSEGMDNILVTWQPPRKDPSAVQEYVVEWRELH
PGGDTQVPLNWLRSRPYNVSALISENIKSYICYEIRVYALSGDQGGCSSILGNSKHKAPLSGPHINAITEEKGSILI
SWNSIPVQEQMGCLLHYRIYWKERDSNSQPQLCEIPYRVSQNSHPINSLQPRVTYVLWMTALTAAGESSHGNEREFC
LQGKANWMAFVAPSICIAIIMVGIFSTHYFQQKVFVLLAALRPQWCSREIPDPANSTCAKKYPIAEEKTQLPLDRLL
IDWPTPEDPEPLVISEVLHQVTPVFRHPPCSNWPQREKGIQGHQASEKDMMHSASSPPPPRALQAESRQLVDLYKVL
ESRGSDPKPENPACPWTVLPAGDLPTHDGYLPSNIDDLPSHEAPLADSLEELEPQHISLSVFPSSSLHPLTFSCGDK
LTLDQLKMRCDSLML

Human IL-12 receptor subunit beta-2 (IL-12Rß2), extracellular domain (SEQ ID NO:8)

>sp|Q99665|24-622
KIDACKRGDVTVKPSHVILLGSTVNITCSLKPRQGCFHYSRRNKLILYKFDRRINFHHGHSLNSQVTGLPLGTTLFV
CKLACINSDEIQICGAEIFVGVAPEQPQNLSCIQKGEQGTVACTWERGRDTHLYTEYTLQLSGPKNLTWQKQCKDIY
CDYLDFGINLTPESPESNFTAKVTAVNSLGSSSSLPSTFTFLDIVRPLPPWDIRIKFQKASVSRCTLYWRDEGLVLL
NRLRYRPSNSRLWNMVNVTKAKGRHDLLDLKPFTEYEFQISSKLHLYKGSWSDWSESLRAQTPEEEPTGMLDVWYMK
RHIDYSRQQISLFWKNLSVSEARGKILHYQVTLQELTGGKAMTQNITGHTSWTTVIPRTGNWAVAVSAANSKGSSLP
TRINIMNLCEAGLLAPRQVSANSEGMDNILVTWQPPRKDPSAVQEYVVEWRELHPGGDTQVPLNWLRSRPYNVSALI
SENIKSYICYEIRVYALSGDQGGCSSILGNSKHKAPLSGPHINAITEEKGSILISWNSIPVQEQMGCLLHYRIYWKE
RDSNSQPQLCEIPYRVSQNSHPINSLQPRVTYVLWMTALTAAGESSHGNEREFCLQGKAN

Figure 2A

| Monomer 1 | Monomer 2 |
|---|---|
| F405A | T394F |
| S364D | Y349K |
| S364E | L368K |
| S364E | Y349K |
| S364F | K370G |
| S364H | Y349K |
| S364H | Y349T |
| S364Y | K370G |
| T411K | K370E |
| V397S/F405A | T394F |
| K370R/T411K | K370E/T411E |
| L351E/S364D | Y349K/L351K |
| L351E/S364E | Y349K/L351K |
| L351E/T366D | L351K/T366K |
| P395T/V397S/F405A | T394F |
| S364D/K370G | S364Y/K370R |
| S364D/T394F | Y349K/F405A |
| S364E/F405A | Y349K/T394F |
| S364E/F405S | Y349K/T394Y |
| S364E/T411E | Y349K/D401K |
| S364H/D401K | Y349T/T411E |
| S364H/F405A | Y349T/T394F |
| S364H/T394F | Y349T/F405A |
| Y349C/S364E | Y349K/S354C |
| L351E/S364D/F405A | Y349K/L351K/T394F |
| L351K/S364H/D401K | Y349T/L351E/T411E |
| S364E/T411E/F405A | Y349K/T394F/D401K |
| S364H/D401K/F405A | Y349T/T394F/T411E |
| S364H/F405A/T411E | Y349T/T394F/D401K |

Figure 2B

| Monomer 1 | Monomer 2 |
|---|---|
| K370E/T411D | T411K |
| L368E/K409E | L368K |
| Y349T/T394F/S354C | S364H/F405A/Y349C |
| T411E | D401K |
| T411E | D401R/T411R |
| Q347E/K360E | Q347R |
| L368E | S364K |
| L368E/K370S | S364K |
| L368E/K370T | S364K |
| L368E/D401R | S364K |
| L368E/D401N | S364K |
| L368E | E357S/S364K |
| L368E | S364K/K409E |
| L368E | S364K/K409V |
| L368D | S364K |
| L368D/K370S | S364K |
| L368D/K370S | S364K/E357L |
| L368D/K370S | S364K/E357Q |
| T411E/K360E/Q362E | D401K |
| K370S | S364K |
| L368E/K370S | S364K/E357Q |
| K370S | S364K/E357Q |
| T411E/K360D | D401K |
| T411E/K360E | D401K |
| T411E/Q362E | D401K |
| T411E/N390D | D401K |
| T411E | D401K/Q347K |
| T411E | D401K/Q347R |
| T411E/K360D/Q362E | D401K |

Figure 2C

| Monomer 1 | Monomer 2 |
|---|---|
| T411E/K360E/N390D | D401K |
| T411E/Q362E/N390D | D401K |
| T411E/Q347R | D401K/K360D |
| T411E/Q347R | D401K/K360E |
| T411E/K360 | D401K/Q347K |
| T411E/K360D | D401K/Q347R |
| T411E/K360E | D401K/Q347K |
| T411E/K360E | D401K/Q347R |
| T411E/S364K | D401K/K370S |
| T411E/K370S | D401K/S364K |
| Q347E | E357Q |
| Q347E | E357Q/Q362K |
| K360D/Q362E | Q347R |
| K360D/Q362E | D401K |
| K360D/Q362E | Q347R/D401K |
| K360E/Q362E | Q347R |
| K360E/Q362E | D401K |
| K360E/Q362E | Q347R/D401K |
| Q362E/N390D | D401K |
| Q347E/K360D | D401N |
| K360D | Q347R/N390K |
| K360D | N390K/D401N |
| K360E | Y349H |
| K370S/Q347E | S364K |
| K370S/E357L | S364K |
| K370S/E357Q | S364K |
| K370S/Q347E/E357L | S364K |
| K370S/Q347E/E357Q | S364K |

Figure 2D

| Monomer 1 | Monomer 2 |
|---|---|
| L368D/K370S/Q347E | S364K |
| L368D/K370S/E357L | S364K |
| L368D/K370S/E357Q | S364K |
| L368D/K370S/Q347E/E357L | S364K |
| L368D/K370S/Q347E/E357Q | S364K |
| L368E/K370S/Q347E | S364K |
| L368E/K370S/E357L | S364K |
| L368E/K370S/E357Q | S364K |
| L368E/K370S/Q347E/E357L | S364K |
| L368E/K370S/Q347E/E357Q | S364K |
| L368D/K370T/Q347E | S364K |
| L368D/K370T/E357L | S364K |
| L368D/K370T/E357Q | S364K |
| L368D/K370T/Q347E/E357L | S364K |
| L368D/K370T/Q347E/E357Q | S364K |
| L368E/K370T/Q347E | S364K |
| L368E/K370T/E357L | S364K |
| L368E/K370T/E357Q | S364K |
| L368E/K370T/Q347E/E357L | S364K |
| L368E/K370T/Q347E/E357Q | S364K |
| T411E/Q362E | D401K/T411K |
| T411E/N390D | D401K/T411K |
| T411E/Q362E | D401R/T411R |
| T411E/N390D | D401R/T411R |
| Y407T | T366Y |
| F405A | T394W |
| T366Y/F405A | T394W/Y407T |
| Y407A | T366W |
| T366S/L368A/Y407V | T366W |
| T366S/L368A/Y407V/Y349C | T366W/S354C |

Figure 2E

| Monomer 1 | Monomer 2 |
|---|---|
| K392D/K409D | E356K/D399K |
| K370D/K392D/K409D | E356K/E357K/D399K |
| K247Q/R355Q/N384S/K392N/V397M/Q419E/K447_ | P217R/P228R/N276K |
| K247Q/R355Q/N384S/K392N/V397M/Q419E/K447_ | N276K |
| N384S/K392N/V397M/Q419E | N276K |
| D221E/P228E/L368E | D221R/P228R/K409R |
| C220E/P228E/L368E | C220R/E224R/P228R/K409R |
| F405L | K409R |
| T366I/K392M/T394W | F405A/Y407V |
| T366V/K409F | L351Y/Y407A |
| T366A/K392E/K409F/T411E | D399R/S400R/Y407A |
| L351K | L351E |
| K247Q/R355Q/Q419E/K447_ | P217R/P228R/N276K |
| K247Q/R355Q/Q419E/K447_ | N276K |
| K274Q/R355Q/N384S/K392N/V397M/Q419E/K447_ | |
| Q295E/N384D/Q418E/N421D | |
| Q295E/Q418E/N421D | |
| P217R/P228R/N276K | |
| N276K | |
| E269Q/E272Q/E283Q/E357Q | |
| E269Q/E272Q/E283Q | |
| E269Q/E272Q | |
| E269Q/E283Q | |
| E272Q/E283Q | |
| E269Q | |

Figure 3

| Variant constant region | Substitutions |
|---|---|
| pI_ISO(-)-Fc only | K274Q/R355Q/N384S/K392N/V397M/Q419E/K447_ |
| pI_(-)_isosteric_A-Fc only | Q295E/N384D/Q418E/N421D |
| pI_(-)_isosteric_B-Fc only | Q295E/Q418E/N421D |
| pI_ISO(+RR)-Fc only | P217R/P228R/N276K |
| pI_ISO(+)-Fc only | N276K |
| pI_(+)_isosteric_A | E269Q/E272Q/E283Q/E357Q |
| pI_(+)_isosteric_B | E269Q/E272Q/E283Q |
| pI_(+)_isosteric_E269Q/E272Q | E269Q/E272Q |
| pI_(+)_isosteric_E269Q/E283Q | E269Q/E283Q |
| pI_(+)_isosteric_E272Q/E283Q | E272Q/E283Q |
| pI_(+)_isosteric_E269Q | E269Q |

Figure 4

Ablation Variants
G236R
S239G
S239K
S239Q
S239R
V266D
S267K
S267R
H268K
E269R
299R
299K
K322A
A327G
A327L
A327N
A327Q
L328E
P329K
A330L
A330S/P331S
I332K
I332R
V266D/A327Q
V266D/P329K
S267R/A327Q
S267R/P329K
G236R/L328R
E233P/L234V/L235A/G236_/S239K
E233P/L234V/L235A/G236_/S267K
E233P/L234V/L235A/G236_/S239K/A327G
E233P/L234V/L235A/G236_/S267K/A327G
E233P/L234V/L235A/G236_
S239K/S267K
267K/P329K

Figure 5

| Monomer 1 (-) | Monomer 2 (+) |
|---|---|
| C220S | C220S |
| Heterodimer pI variants L368D/K370S | Heterodimer pI variants S364K/E357Q |
| Isosteric pI substitutions Q295E/N384D/Q418E/N421D | |
| FcKO E233P/L234V/L235A/G236_/S267K | FcKO E233P/L234V/L235A/G236_/S267K |
| ±M428L/N434S | ±M428L/N434S |

Figure 6

| Name | Sequence | SEQ ID NO: |
|---|---|---|
| (GGGGS)$_1$ or GGGGS | GGGGS | 9 |
| (GGGGS)$_2$ | GGGGSGGGGS | 10 |
| (GGGGS)$_3$ | GGGGSGGGGSGGGGS | 11 |
| (GGGGS)$_4$ | GGGGSGGGGSGGGGSGGGGS | 12 |
| (GGGGS)$_5$ | GGGGSGGGGSGGGGSGGGGSGGGGS | 13 |
| (GGGGS)$_6$ | GGGGSGGGGSGGGGSGGGGSGGGGSGGGGS | 14 |
| (GGGGS)$_7$ | GGGGSGGGGSGGGGSGGGGSGGGGSGGGGSGGGGS | 15 |
| (GGGGA)$_1$ or GGGGA | GGGGA | SEQ ID NO:247 |
| (GGGGA)$_2$ | GGGGAGGGGA | SEQ ID NO:248 |
| (GGGGA)$_3$ | GGGGAGGGGAGGGGA | SEQ ID NO:249 |
| (GGGGA)$_4$ | GGGGAGGGGAGGGGAGGGGA | SEQ ID NO:250 |
| (GGGGA)$_5$ | GGGGAGGGGAGGGGAGGGGAGGGGA | SEQ ID NO:251 |
| (GGGGA)$_6$ | GGGGAGGGGAGGGGAGGGGAGGGGAGGGGA | SEQ ID NO:252 |
| (GGGGA)$_7$ | GGGGAGGGGAGGGGAGGGGAGGGGAGGGGAGGGGA | SEQ ID NO:253 |
| 30AA-linker | DPALVHQRPAPPGGGGSGGGGSGGGGSGGG | 16 |
| (GKPGS)$_1$ or GKPGS | GKPGS | 17 |
| (GKPGS)$_5$ | GKPGSGKPGSGKPGSGKPGSGKPGS | 18 |
| (GKPGS)$_6$ | GKPGSGKPGSGKPGSGKPGSGKPGSGKPGS | 19 |
| (GGGES)$_1$ or GGGES | GGGES | 20 |

Figure 7

Positive Charged scFv Linkers

| Name | Sequence | Length | Charge | SEQ ID NO: |
|---|---|---|---|---|
| Gly-Ser 15 | GGGGSGGGGSGGGGS | 15 | 0 | SEQ ID NO:11 |
| Whitlow linker | GSTSGSGKPGSGEGSTKG | 18 | +1 | SEQ ID NO:432 |
| 6paxA_1 (+A) | IRPRAIGGSKPRVA | 14 | +4 | SEQ ID NO:457 |
| +B | GKGGSGKGGSGKGGS | 15 | +3 | SEQ ID NO:462 |
| +C | GGKGSGGKGSGGKGS | 15 | +3 | SEQ ID NO:463 |
| +D | GGGKSGGGKSGGGKS | 15 | +3 | SEQ ID NO:464 |
| +E | GKGKSGKGKSGKGKS | 15 | +6 | SEQ ID NO:465 |
| +F | GGGKSGGKGSGKGGS | 15 | +3 | SEQ ID NO:466 |
| +G | GKPGSGKPGSGKPGS | 15 | +3 | SEQ ID NO:731 |
| +H | GKPGSGKPGSGKPGSGKPGS | 20 | +4 | SEQ ID NO:734 |
| +I | GKGKSGKGKSGKGKSGKGKS | 20 | +8 | SEQ ID NO:748 |

Negative Charged scFv Linkers

| Name | Sequence | Length | Charge | SEQ ID NO: |
|---|---|---|---|---|
| Gly-Ser 20 | GGGGSGGGGSGGGGSGGGGS | 20 | 0 | SEQ ID NO:12 |
| 3hsc_2 (-A) | STAGDTHLGGEDFD | 14 | -4 | SEQ ID NO:753 |
| -B | GEGGSGEGGSGEGGS | 15 | -3 | SEQ ID NO:756 |
| -C | GGEGSGGEGSGGEGS | 15 | -3 | SEQ ID NO:757 |
| -D | GGGESGGGESGGGES | 15 | -3 | SEQ ID NO:760 |
| -E | GEGESGEGESGEGES | 15 | -6 | SEQ ID NO:761 |
| -F | GGGESGGEGSGEGGS | 15 | -3 | SEQ ID NO:762 |
| -G | GEGESGEGESGEGESGEGES | 20 | -8 | SEQ ID NO:788 |

Additional scFv Linkers

| Sequence | SEQ ID NO: |
|---|---|
| GGGGSGGGGSGGGGS | SEQ ID NO:11 |
| GGGGSGGGGSGGGGSGGGGS | SEQ ID NO:12 |
| GSTSGSGKPGSGEGSTKG | SEQ ID NO:432 |
| PRGASKSGSASQTGSAPGS | SEQ ID NO:796 |
| GTAAAGAGAAGGAAAGAAG | SEQ ID NO:816 |
| GTSGSSGSGSGGSGSGGG | SEQ ID NO:817 |
| GKPGSGKPGSGKPGSGKPGS | SEQ ID NO:828 |

Figure 8A

Backbone 1

>Backbone 1 monomer 1 (SEQ ID NO:21)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >Backbone 1 monomer 2 (SEQ ID NO:22)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK Backbone 2

>Backbone 2 monomer 1 (SEQ ID NO:23)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >Backbone monomer 2 (SEQ ID NO:24)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK Backbone 3

>Backbone 3 monomer 1 (SEQ ID NO:25)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >Backbone 3 monomer 2 (SEQ ID NO:26)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CEVSGFYPSDIAVEWESDGQPENNYKTTPPVLDSDGSFFLYSKLTVDKSRWEQGDVFSCSVMHEALHNHYTQKSL
SLSPGK Backbone 4

>Backbone 4 monomer 1 (SEQ ID NO:27)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSKGSFFLYSKLTVDKSRWQQGNVFSCSVMHEALHNHYTQKSL
SLSPGK >Backbone 4 monomer 2 (SEQ ID NO:28)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTENEVSLT
CLVKGFYPSDIAVEWESDGQPENNYKTTPPVLDSDGSFFLYSKLEVDKSRWEQGDVFSCSVMHEALHNHYTQKSL
SLSPGK

Figure 8B

Backbone 5

>Backbone 5 monomer 1 (SEQ ID NO:29)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSRDQLTKNQVKLT
CLVKGFYPSDIAVEWESNGQPENNYKTTPPVLDSDGSFFLYSKLTVDKSRWQQGNVFSCSVMHEALHNHYTQKSL
SLSPGK >Backbone 5 monomer 2 (SEQ ID NO:30)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSRDELTKNQVSLT
CDVSGFYPSDIAVEWESDGQPENNYKTTPPVLDSDGSFFLYSKLTVDKSRWEQGDVFSCSVMHEALHNHYTQKSL
SLSPGK Backbone 6

>Backbone 6 monomer 1 (SEQ ID NO:31)
EPKSSDKTHTCPPCPAPPVAGPSVFLFPPKPKDTLMISRTPEVTCVVVDVKHEDPEVKFNWYVDGVEVHNAKTKP
REEQYASTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >Backbone 6 monomer 2 (SEQ ID NO:32)
EPKSSDKTHTCPPCPAPPVAGPSVFLFPPKPKDTLMISRTPEVTCVVVDVKHEDPEVKFNWYVDGVEVHNAKTKP
REEEYASTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK Backbone 7

>Backbone 7 monomer 1 (SEQ ID NO:33)
EPKSSDKTHTCPPCPAPPVAGPSVFLFPPKPKDTLMISRTPEVTCVVVDVKHEDPEVKFNWYVDGVEVHNAKTKP
REEQYSSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK >Backbone 7 monomer 2 (SEQ ID NO:34)
EPKSSDKTHTCPPCPAPPVAGPSVFLFPPKPKDTLMISRTPEVTCVVVDVKHEDPEVKFNWYVDGVEVHNAKTKP
REEEYSSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK Backbone 8

>Backbone 8 monomer 1 (SEQ ID NO:35)
ESKYGPPCPPCPAPEFLGGPSVFLFPPKPKDTLMISRTPEVTCVVVDVSQEDPEVQFNWYVDGVEVHNAKTKPRE
EQFNSTYRVVSVLTVLHQDWLNGKEYKCKVSNKGLPSSIEKTISKAKGQPREPQVYTLPPSQEQMTKNQVKLTCL
VKGFYPSDIAVEWESNGQPENNYKTTPPVLDSDGSFFLYSRLTVDKSRWQEGNVFSCSVMHEALHNHYTQKSLSL
SLGK >Backbone 8 monomer 2 (SEQ ID NO:36)
ESKYGPPCPPCPAPEFLGGPSVFLFPPKPKDTLMISRTPEVTCVVVDVSQEDPEVQFNWYVDGVEVHNAKTKPRE
EEFNSTYRVVSVLTVLHQDWLNGKEYKCKVSNKGLPSSIEKTISKAKGQPREPQVYTLPPSQEEMTKNQVSLTCD
VSGFYPSDIAVEWESDGQPENNYKTTPPVLDSDGSFFLYSRLTVDKSRWEEGDVFSCSVMHEALHNHYTQKSLSL
SLGK

Figure 8C

Backbone 9

>Backbone 9 monomer 1 (SEQ ID NO:37)
ERKCCVECPPCPAPPVAGPSVFLFPPKPKDTLMISRTPEVTCVVVDVSHEDPEVQFNWYVDGVEVHNAKTKPREE
QFNSTFRVVSVLTVVHQDWLNGKEYKCKVSNKGLPAPIEKTISKTKGQPREPQVYTLPPSREQMTKNQVKLTCLV
KGFYPSDIAVEWESNGQPENNYKTTPPMLDSDGSFFLYSKLTVDKSRWQQGNVFSCSVMHEALHNHYTQKSLSLS
PGK >Backbone 9 monomer 2 (SEQ ID NO:38)
ERKCCVECPPCPAPPVAGPSVFLFPPKPKDTLMISRTPEVTCVVVDVSHEDPEVQFNWYVDGVEVHNAKTKPREE
EFNSTFRVVSVLTVVHQDWLNGKEYKCKVSNKGLPAPIEKTISKTKGQPREPQVYTLPPSREEMTKNQVSLTCDV
SGFYPSDIAVEWESDGQPENNYKTTPPMLDSDGSFFLYSKLTVDKSRWEQGDVFSCSVMHEALHNHYTQKSLSLS
PGK

Backbone 10

>Backbone 10 monomer 1 (SEQ ID NO:39)
ERKCCVECPPCPAPPVAGPSVFLFPPKPKDTLMISRTPEVTCVVVDVKHEDPEVQFNWYVDGVEVHNAKTKPREE
QFNSTFRVVSVLTVVHQDWLNGKEYKCKVSNKGLPAPIEKTISKTKGQPREPQVYTLPPSREQMTKNQVKLTCLV
KGFYPSDIAVEWESNGQPENNYKTTPPMLDSDGSFFLYSKLTVDKSRWQQGNVFSCSVMHEALHNHYTQKSLSLS
PGK >Backbone 10 monomer 2 (SEQ ID NO:40)
ERKCCVECPPCPAPPVAGPSVFLFPPKPKDTLMISRTPEVTCVVVDVKHEDPEVQFNWYVDGVEVHNAKTKPREE
EFNSTFRVVSVLTVVHQDWLNGKEYKCKVSNKGLPAPIEKTISKTKGQPREPQVYTLPPSREEMTKNQVSLTCDV
SGFYPSDIAVEWESDGQPENNYKTTPPMLDSDGSFFLYSKLTVDKSRWEQGDVFSCSVMHEALHNHYTQKSLSLS
PGK

Backbone 11

>Backbone 11 monomer 1 (SEQ ID NO:41)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVLHEALHSHYTQKSL
SLSPGK >Backbone 11 monomer 2 (SEQ ID NO:42)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVLHEALHSHYTQKSL
SLSPGK

Backbone 12

>Backbone 12 monomer 1 (SEQ ID NO:43)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQKSL
SLSPGK >Backbone 12 monomer 2 (SEQ ID NO:44)
EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREEMTKNQVSLT
CLVKGFYPSDIAVEWESNGQPENNYKTTPPVLDSDGSFFLYSKLTVDKSRWQQGNVFSCSVMHEALHNHYTQKSL
SLSPGK

Figure 8D

Backbone 13

\>Backbone 13 monomer 1 (SEQ ID NO:45)
EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPGK \>Backbone 13 monomer 2 (SEQ ID NO:46)
ERKSSDKTHTCPRCPAPPVAGPSVFLFPPKPKDTLMISRTPEVTCVVVDVKHEDPEVKFKWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK IL-12-heteroFc
Example: XENP27201 heteroFc-IL-12
Example: XENP27202 scIL-12(p40/p35)-Fc
Example: XENP27203 scIL-12(p35/p40)-Fc
Example: XENP27204

Fc-scIL-12(p40/p35)

Fc-scIL-12(p35/p40)

Figure 10

>XENP27201 human_IL12p40_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

*Chain 1 - human_IL12p40_(GGGGS)2_Fc(216)_IgG1_pI(-)_Isosteric_A_C220S/PVA_/S267K/L368D/K370S*

IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/<u>GGGGSGGGGS</u>/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK (SEQ ID NO:47)

*Chain 2 - human_IL12p35_(GGGGS)2_Fc(216)_IgG1_C220S/PVA_/S267K/S364K/E357Q*

RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/<u>GGGGSGGGGS</u>/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:48)

Figure 11

>XENP27202 empty-Fc(216)_IgG1_pI(-)_Isosteric_A_C220S/PVA_/S267K/L368D/K370S_(GGGGS)2_human_IL12p40-empty-Fc(216)_IgG1_C220S/PVA_/S267K/S364K/E357Q_(GGGGS)2_human_IL12p35

*Chain 1 - empty-Fc(216)_IgG1_pI(-)_Isosteric_A_C220S/PVA_/S267K/L368D/K370S_(GGGGS)2_human_IL12p40*

EPKSSDKTHTCPPCPAPPVAGPSVFLFPPKPKDTLMISRTPEVTCVVVDVKHEDPEVKFNWYVDGVEVHNAKTKP
REEEYNSTYRVVSVLTVLHQDWLNGKEYKCKVSNKALPAPIEKTISKAKGQPREPQVYTLPPSREEMTKNQVSLT
CDVSGFYPSDIAVEWESDGQPENNYKTTPPVLDSDGSFFLYSKLTVDKSRWEQGDVFSCSVMHEALHNHYTQKSL
SLSPG/<u>GGGGSGGGGS</u>/IWELKKDVYVVELDWYPDAPGEMVVLTCDTPEEDGITWTLDQSSEVLGSGKTLTIQVK
EFGDAGQYTCHKGGEVLSHSLLLLHKKEDGIWSTDILKDQKEPKNKTFLRCEAKNYSGRFTCWWLTTISTDLTFS
VKSSRGSSDPQGVTCGAATLSAERVRGDNKEYEYSVECQEDSACPAAEESLPIEVMVDAVHKLKYENYTSSFFIR
DIIKPDPPKNLQLKPLKNSRQVEVSWEYPDTWSTPHSYFSLTFCVQVQGKSKREKKDRVFTDKTSATVICRKNAS
ISVRAQDRYYSSSWSEWASVPCS (SEQ ID NO:49)

*Chain 2 - human_IL12p40-empty-Fc(216)_IgG1_C220S/PVA_/S267K/S364K/E357Q_(GGGGS)2_human_IL12p35*

EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPG/<u>GGGGSGGGGS</u>/RNLPVATPDPGMFPCLHHSQNLLRAVSNMLQKARQTLEFYPCTSEEIDHEDITKDKTS
TVEACLPLELTKNESCLNSRETSFITNGSCLASRKTSFMMALCLSSIYEDLKMYQVEFKTMNAKLLMDPKRQIFL
DQNMLAVIDELMQALNFNSETVPQKSSLEEPDFYKTKIKLCILLHAFRIRAVTIDRVMSYLNAS (SEQ ID NO:50)

Figure 12

>XENP27203 human_IL12p40_(GGGGS)5-human_IL12p35_(GGGGS)2_(single-Chain
)-empty-Fc_Fc(216)_IgG1_pI(-)_Isosteric_A_C220S/PVA_/S267K/L368D/K370S-
Fc(216)_IgG1_C220S/PVA_/S267K/S364K/E357Q

*Chain 1 - human_IL12p40_(GGGGS)5-human_IL12p35_(GGGGS)2_(single-Chain
)_Fc(216)_IgG1_pI(-)_Isosteric_A_C220S/PVA_/S267K/L368D/K370S*

IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO:51)

*Chain 2 - empty-Fc(216)_IgG1_C220S/PVA_/S267K/S364K/E357Q*

EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK (SEQ ID NO:52)

>XENP27204 human_IL12p35_(GGGGS)5-human_IL12p40_(GGGGS)2_(single-Chain
)-empty-Fc_Fc(216)_IgG1_pI(-)_Isosteric_A_C220S/PVA_/S267K/L368D/K370S-
Fc(216)_IgG1_C220S/PVA_/S267K/S364K/E357Q

*Chain 1 - human_IL12p35_(GGGGS)5-human_IL12p40_(GGGGS)2_(single-Chain
)_Fc(216)_IgG1_pI(-)_Isosteric_A_C220S/PVA_/S267K/L368D/K370S*

RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGSGGGGSGGGGSGGGGS/I
WELKKDVYVVELDWYPDAPGEMVVLTCDTPEEDGITWTLDQSSEVLGSGKTLTIQVKEFGDAGQYTCHKGGEVLS
HSLLLLHKKEDGIWSTDILKDQKEPKNKTFLRCEAKNYSGRFTCWWLTTISTDLTFSVKSSRGSSDPQGVTCGAA
TLSAERVRGDNKEYEYSVECQEDSACPAAEESLPIEVMVDAVHKLKYENYTSSFFIRDIIKPDPPKNLQLKPLKN
SRQVEVSWEYPDTWSTPHSYFSLTFCVQVQGKSKREKKDRVFTDKTSATVICRKNASISVRAQDRYYSSSWSEWA
SVPCS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO:53)

*Chain 2 - empty-Fc(216)_IgG1_C220S/PVA_/S267K/S364K/E357Q*

EPKSSDKTHTCPPCPAPPVAGPSVFLFPPKPKDTLMISRTPEVTCVVVDVKHEDPEVKFNWYVDGVEVHNAKTKP
REEQYNSTYRVVSVLTVLHQDWLNGKEYKCKVSNKALPAPIEKTISKAKGQPREPQVYTLPPSREQMTKNQVKLT
CLVKGFYPSDIAVEWESNGQPENNYKTTPPVLDSDGSFFLYSKLTVDKSRWQQGNVFSCSVMHEALHNHYTQKSL
SLSPGK (SEQ ID NO:54)

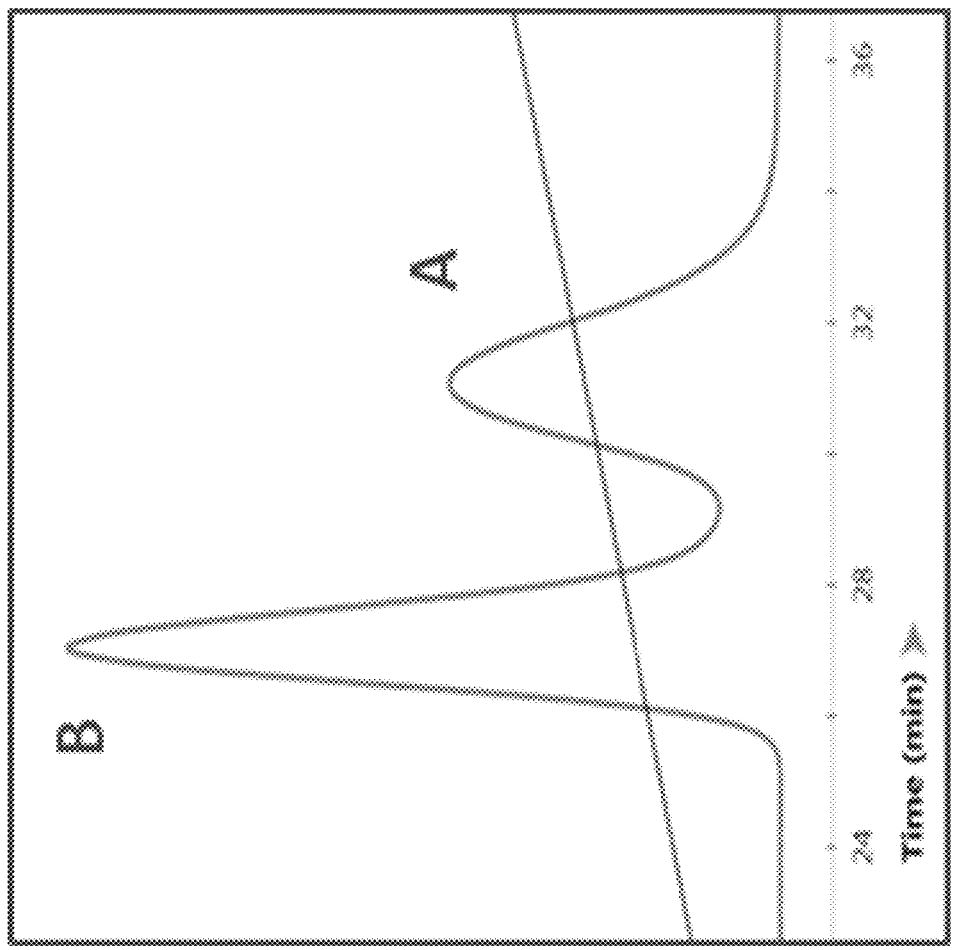

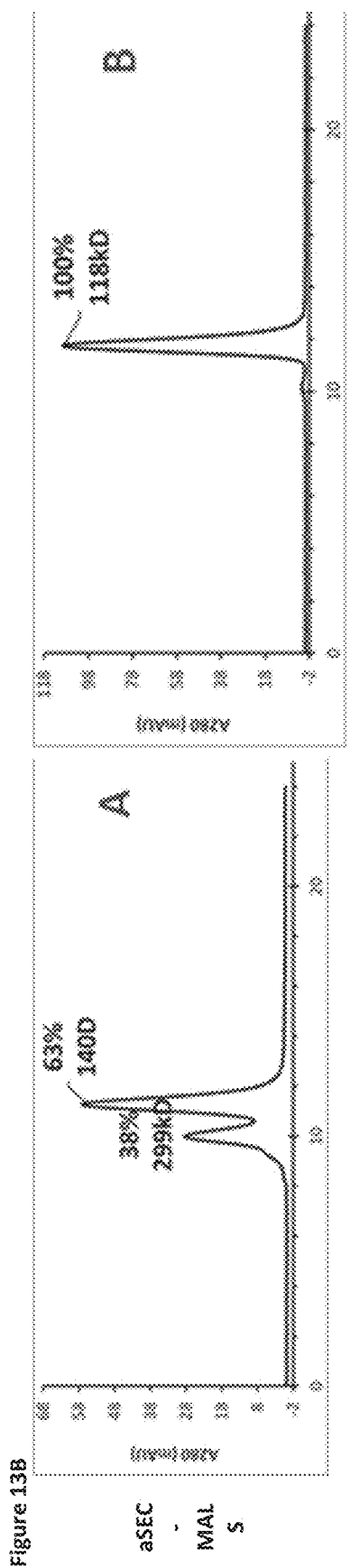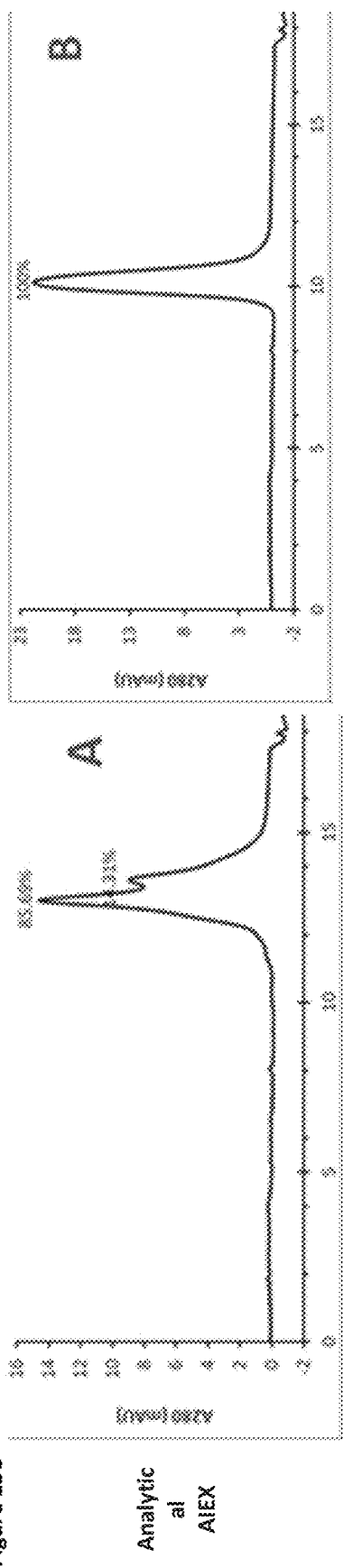

Purification of eluate from Protein A Chromatography via Anion Exchange Chromatography Bivalent IL-12p40-Fc
Example: XENP27560

Bivalent IL-12p35-Fc
Example: XENP27561

Figure 16

>XENP27560 human IL12p40 (GGGGS)2-Fc(216) IgG1 pI(-) Isosteric_A C220S/PVA /S267K/L368D/K370S homodimer

IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK (SEQ ID NO:55)

>XENP27561 human IL12p35 (GGGGS)2 Fc(216) IgG1 C220S/PVA /S267K/S364K/E357Q homodimer

RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:56)

Figure 18

| RESIDUE |
|---|
| W15 |
| P17 |
| D18 |
| A19 |
| P20 |
| G21 |
| M23 |
| L40 |
| D41 |
| Q42 |
| S43 |
| E45 |
| L47 |
| T54 |
| I55 |
| Q56 |
| K58 |
| E59 |
| F60 |
| G61 |
| D62 |
| Y66 |
| K84 |

Figure 19

| Residue | ASA | Residue | ASA |
|---|---|---|---|
| E3 | 85 | Q144 | 150 |
| D7 | 22 | E156 | 90 |
| E12 | 72 | D161 | 161 |
| D14 | 26 | N162 | 62 |
| D18 | 140 | E166 | 20 |
| E22 | 50 | E170 | 81 |
| D29 | 89 | Q172 | 72 |
| E32 | 80 | D174 | 93 |
| E33 | 113 | E187 | 63 |
| D41 | 54 | N200 | 57 |
| Q42 | 188 | D209 | 73 |
| E45 | 143 | D214 | 46 |
| Q56 | 105 | N218 | 67 |
| E59 | 86 | Q220 | 99 |
| D62 | 32 | N226 | 134 |
| Q65 | 75 | Q229 | 114 |
| E73 | 155 | E231 | 34 |
| E86 | 88 | E235 | 105 |
| D93 | 87 | Q256 | 104 |
| D97 | 22 | E262 | 147 |
| E100 | 148 | D265 | 60 |
| N103 | 86 | D270 | 58 |
| E110 | 41 | N281 | 71 |
| D129 | 71 | Q289 | 19 |
| D142 | 69 | E299 | 106 |

Figure 20

| RESIDUE | CONTACT TYPE |
|---|---|
| D87 | DIH |
| G88 | D |
| I89 | D |
| W90 | D |
| K104 | DA |
| F106 | D |

Figure 21A

> IL-12p40(N103D) (SEQ ID NO:57)
IWELKKDVYVVELDWYPDAPGEMVVLTCDTPEEDGITWTLDQSSEVLGSKTLTIQVKEFGDAGQYTCHKGGEVL
SHSLLLLHKKEDGIWSTDILKDQKEPKDKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

> IL-12p40(N113D) (SEQ ID NO:58)
IWELKKDVYVVELDWYPDAPGEMVVLTCDTPEEDGITWTLDQSSEVLGSKTLTIQVKEFGDAGQYTCHKGGEVL
SHSLLLLHKKEDGIWSTDILKDQKEPKNKTFLRCEAKDYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

> IL-12p40(N200D) (SEQ ID NO:59)
IWELKKDVYVVELDWYPDAPGEMVVLTCDTPEEDGITWTLDQSSEVLGSKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEDYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

> IL-12p40(N281D) (SEQ ID NO:60)
IWELKKDVYVVELDWYPDAPGEMVVLTCDTPEEDGITWTLDQSSEVLGSKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKDASISVRAQDRYYSSSWSEW
ASVPCS

> IL-12p40(N103D/N113D/N200D/N281D) (SEQ ID NO:61)
IWELKKDVYVVELDWYPDAPGEMVVLTCDTPEEDGITWTLDQSSEVLGSKTLTIQVKEFGDAGQYTCHKGGEVL
SHSLLLLHKKEDGIWSTDILKDQKEPKDKTFLRCEAKDYSGRFTCWWLTTISTDLTFSVKSSRGSSDPQGVTCGA
ATLSAERVRGDNKEYEYSVECQEDSACPAAEESLPIEVMVDAVHKLKYEDYTSSFFIRDIIKPDPPKNLQLKPLK
NSRQVEVSWEYPDTWSTPHSYFSLTFCVQVQGKSKREKKDRVFTDKTSATVICRKDASISVRAQDRYYSSSWSEW
ASVPCS

> IL-12p40(Q42E) (SEQ ID NO:62)
IWELKKDVYVVELDWYPDAPGEMVVLTCDTPEEDGITWTLDESSEVLGSKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

> IL-12p40(E45Q) (SEQ ID NO:63)
IWELKKDVYVVELDWYPDAPGEMVVLTCDTPEEDGITWTLDQSSQVLGSKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

> IL-12p40(Q56E) (SEQ ID NO:64)
IWELKKDVYVVELDWYPDAPGEMVVLTCDTPEEDGITWTLDQSSEVLGSKTLTIEVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

Figure 21B

> IL-12p40(E59Q) (SEQ ID NO:65)
IWELKKDVYVVELDWYPDAPGEMVVLTCDTPEEDGITWTLDQSSEVLGSGKTLTIQVKQFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

> IL-12p40(D62N) (SEQ ID NO:66)
IWELKKDVYVVELDWYPDAPGEMVVLTCDTPEEDGITWTLDQSSEVLGSGKTLTIQVKEFGNAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

> IL-12p40(Q42E/E45Q) (SEQ ID NO:67)
IWELKKDVYVVELDWYPDAPGEMVVLTCDTPEEDGITWTLDESSQVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

> IL-12p40(E45Q/Q56E) (SEQ ID NO:68)
IWELKKDVYVVELDWYPDAPGEMVVLTCDTPEEDGITWTLDQSSQVLGSGKTLTIEVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

> IL-12p40(Q42E/E59Q) (SEQ ID NO:69)
IWELKKDVYVVELDWYPDAPGEMVVLTCDTPEEDGITWTLDESSEVLGSGKTLTIQVKQFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

> IL-12p40(Q56E/E59Q) (SEQ ID NO:70)
IWELKKDVYVVELDWYPDAPGEMVVLTCDTPEEDGITWTLDQSSEVLGSGKTLTIEVKQFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

> IL-12p40(Q42E/E45Q/Q56E) (SEQ ID NO:71)
IWELKKDVYVVELDWYPDAPGEMVVLTCDTPEEDGITWTLDESSQVLGSGKTLTIEVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

> IL-12p40(E45Q/Q56E/E59Q) (SEQ ID NO:72)
IWELKKDVYVVELDWYPDAPGEMVVLTCDTPEEDGITWTLDQSSQVLGSGKTLTIEVKQFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

Figure 21C

> IL-12p40(D161N) (SEQ ID NO:73)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGNNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

> IL-12p40(E73Q) (SEQ ID NO:74)
IWELKKDVYVVELDWYPDAPGEMVVLTCDTPEEDGITWTLDQSSEVLGSGKTLTIQVKEFGDAGQYTCHKGGQVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

> IL-12p40(Q144E) (SEQ ID NO:75)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPEGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

> IL-12p40(E262Q) (SEQ ID NO:76)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKRQKKDRVFTDKTSATVICRKNASISVRAQDRYYSSSWSEW
ASVPCS

> IL-12p40(E100Q) (SEQ ID NO:77)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKQPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

> IL-12p40(D18N) (SEQ ID NO:78)
IWELKKDVYVVELDWYPNAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

> IL-12p40(E33Q) (SEQ ID NO:79)
IWELKKDVYVVELDWYPDAPGEMVVLTCDTPEQDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

> IL-12p40(Q229E) (SEQ ID NO:80)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSREVEVSWEYPDTWSTPHSYFSLTFCVQVQGKSKREKKDRVFTDKTSATVICRKNASISVRAQDRYYSSSWSEW
ASVPCS

Figure 21D

> IL-12p40(E235Q) (SEQ ID NO:81)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWQYPDTWSTPHSYFSLTFCVQVQGKSKREKKDRVFTDKTSATVICRKNASISVRAQDRYYSSSWSEW
ASVPCS

> IL-12p40(Q256N) (SEQ ID NO:82)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVNGKSKREKKDRVFTDKTSATVICRKNASISVRAQDRYYSSSWSEW
ASVPCS

> IL-12p40(E299Q) (SEQ ID NO:83)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSQW
ASVPCS

> IL-12p40(D87N) (SEQ ID NO:84)
IWELKKDVYVVELDWYPDAPGEMVVLTCDTPEEDGITWTLDQSSEVLGSGKTLTIQVKEFGDAGQYTCHKGGEVL
SHSLLLLHKKENGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

> IL-12p40(N103D/N113D) (SEQ ID NO:254)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKDKTFLRCEAKDYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

> IL-12p40(N103D/N200D) (SEQ ID NO:255)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKDKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEDYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

> IL-12p40(N103D/N281D) (SEQ ID NO:256)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKDKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKDASISVRAQDRYYSSSWSEW
ASVPCS

> IL-12p40(N113D/N200D) (SEQ ID NO:257)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKDYSGRFTCWWLTTISTDLTFSVKSSRGSSDPQGVTCGA
ATLSAERVRGDNKEYEYSVECQEDSACPAAEESLPIEVMVDAVHKLKYEDYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

Figure 21E

> IL-12p40(N113D/N281D) (SEQ ID NO:258)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKDYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKDASISVRAQDRYYSSSWSEW
ASVPCS

> IL-12p40(N200D/N281D) (SEQ ID NO:259)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEDYTSSFFIRDIIKPDPPKNLQLKPLK
NSRQVEVSWEYPDTWSTPHSYFSLTFCVQVQGKSKREKKDRVFTDKTSATVICRKDASISVRAQDRYYSSSWSEW
ASVPCS

> IL-12p40(N103D/N113D/N200D) (SEQ ID NO:260)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKDKTFLRCEAKDYSGRFTCWWLTTISTDLTFSVKSSRGSSDPQGVTCGA
ATLSAERVRGDNKEYEYSVECQEDSACPAAEESLPIEVMVDAVHKLKYEDYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

> IL-12p40(N103D/N113D/N281D) (SEQ ID NO:261)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKDKTFLRCEAKDYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKDASISVRAQDRYYSSSWSEW
ASVPCS

> IL-12p40(N103D/N200D/N281D) (SEQ ID NO:262)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKDKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEDYTSSFFIRDIIKPDPPKNLQLKPLK
NSRQVEVSWEYPDTWSTPHSYFSLTFCVQVQGKSKREKKDRVFTDKTSATVICRKDASISVRAQDRYYSSSWSEW
ASVPCS

> IL-12p40(N113D/N200D/N281D) (SEQ ID NO:263)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKDYSGRFTCWWLTTISTDLTFSVKSSRGSSDPQGVTCGA
ATLSAERVRGDNKEYEYSVECQEDSACPAAEESLPIEVMVDAVHKLKYEDYTSSFFIRDIIKPDPPKNLQLKPLK
NSRQVEVSWEYPDTWSTPHSYFSLTFCVQVQGKSKREKKDRVFTDKTSATVICRKDASISVRAQDRYYSSSWSEW
ASVPCS

> IL-12p40(N103Q) (SEQ ID NO:264)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKQKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

> IL-12p40(N113Q) (SEQ ID NO:265)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKQYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

Figure 21F

> IL-12p40(N200Q) (SEQ ID NO:266)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

> IL-12p40(N281Q) (SEQ ID NO:267)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKQASISVRAQDRYYSSSWSEW
ASVPCS

> IL-12p40(N103Q/N113Q) (SEQ ID NO:268)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKQKTFLRCEAKQYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

> IL-12p40(N103Q/N200Q) (SEQ ID NO:269)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKQKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

> IL-12p40(N103Q/N281Q) (SEQ ID NO:270)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKQKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKQASISVRAQDRYYSSSWSEW
ASVPCS

> IL-12p40(N113Q/N200Q) (SEQ ID NO:271)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKQYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

> IL-12p40(N113Q/N281Q) (SEQ ID NO:272)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKQYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKQASISVRAQDRYYSSSWSEW
ASVPCS

> IL-12p40(N200Q/N281Q) (SEQ ID NO:273)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKQASISVRAQDRYYSSSWSEW
ASVPCS

Figure 21G

> IL-12p40(N103Q/N113Q/N200Q) (SEQ ID NO:274)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKQKTFLRCEAKQYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

> IL-12p40(N103Q/N113Q/N281Q) (SEQ ID NO:275)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKQKTFLRCEAKQYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKQASISVRAQDRYYSSSWSEW
ASVPCS

> IL-12p40(N103Q/N200Q/N281Q) (SEQ ID NO:276)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKQKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKQASISVRAQDRYYSSSWSEW
ASVPCS

> IL-12p40(N113Q/N200Q/N281Q) (SEQ ID NO:277)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKQYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKQASISVRAQDRYYSSSWSEW
ASVPCS

> IL-12p40(N103Q/N113Q/N200Q/N281Q) (SEQ ID NO:278)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKQKTFLRCEAKQYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKQASISVRAQDRYYSSSWSEW
ASVPCS

Figure 22A

\>XenD24752 human_IL12p40_N103D_(GGGGS)2-Fc(216)_IgG1_pI(-
)_Isosteric_A_C220S/PVA_/S267K/L368D/K370S_pTT5
*IWELKKDVYVVELDWYPDAPGEMVVLTCDTPEEDGITWTLDQSSEVLGSGKTLTIQVKEFGDAGQYTC
HKGGEVLSHSLLLLHKKEDGIWSTDILKDQKEPKDKTFLRCEAKNYSGRFTCWWLTTISTDLTFSVKS
SRGSSDPQGVTCGAATLSAERVRGDNKEYEYSVECQEDSACPAAEESLPIEVMVDAVHKLKYENYTSS
FFIRDIIKPDPPKNLQLKPLKNSRQVEVSWEYPDTWSTPHSYFSLTFCVQVQGKSKREKKDRVFTDKT
SATVICRKNASISVRAQDRYYSSSWSEWASVPCS\GGGGSGGGGS\EPKSSDKTHTCPPCPAPPVAGP
SVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLS
LSPGK* (SEQ ID NO:85)

\>XenD24753 human_IL12p40_N113D_(GGGGS)2-Fc(216)_IgG1_pI(-
)_Isosteric_A_C220S/PVA_/S267K/L368D/K370S_pTT5
*IWELKKDVYVVELDWYPDAPGEMVVLTCDTPEEDGITWTLDQSSEVLGSGKTLTIQVKEFGDAGQYTC
HKGGEVLSHSLLLLHKKEDGIWSTDILKDQKEPKNKTFLRCEAKDYSGRFTCWWLTTISTDLTFSVKS
SRGSSDPQGVTCGAATLSAERVRGDNKEYEYSVECQEDSACPAAEESLPIEVMVDAVHKLKYENYTSS
FFIRDIIKPDPPKNLQLKPLKNSRQVEVSWEYPDTWSTPHSYFSLTFCVQVQGKSKREKKDRVFTDKT
SATVICRKNASISVRAQDRYYSSSWSEWASVPCS\GGGGSGGGGS\EPKSSDKTHTCPPCPAPPVAGP
SVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLS
LSPGK* (SEQ ID NO:86)

\>XenD24754 human_IL12p40_N200D_(GGGGS)2-Fc(216)_IgG1_pI(-
)_Isosteric_A_C220S/PVA_/S267K/L368D/K370S_pTT5
*IWELKKDVYVVELDWYPDAPGEMVVLTCDTPEEDGITWTLDQSSEVLGSGKTLTIQVKEFGDAGQYTC
HKGGEVLSHSLLLLHKKEDGIWSTDILKDQKEPKNKTFLRCEAKNYSGRFTCWWLTTISTDLTFSVKS
SRGSSDPQGVTCGAATLSAERVRGDNKEYEYSVECQEDSACPAAEESLPIEVMVDAVHKLKYEDYTSS
FFIRDIIKPDPPKNLQLKPLKNSRQVEVSWEYPDTWSTPHSYFSLTFCVQVQGKSKREKKDRVFTDKT
SATVICRKNASISVRAQDRYYSSSWSEWASVPCS\GGGGSGGGGS\EPKSSDKTHTCPPCPAPPVAGP
SVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLS
LSPGK* (SEQ ID NO:87)

\>XenD24755 human_IL12p40_N281D_(GGGGS)2-Fc(216)_IgG1_pI(-
)_Isosteric_A_C220S/PVA_/S267K/L368D/K370S_pTT5
*IWELKKDVYVVELDWYPDAPGEMVVLTCDTPEEDGITWTLDQSSEVLGSGKTLTIQVKEFGDAGQYTC
HKGGEVLSHSLLLLHKKEDGIWSTDILKDQKEPKNKTFLRCEAKNYSGRFTCWWLTTISTDLTFSVKS
SRGSSDPQGVTCGAATLSAERVRGDNKEYEYSVECQEDSACPAAEESLPIEVMVDAVHKLKYENYTSS
FFIRDIIKPDPPKNLQLKPLKNSRQVEVSWEYPDTWSTPHSYFSLTFCVQVQGKSKREKKDRVFTDKT
SATVICRKDASISVRAQDRYYSSSWSEWASVPCS\GGGGSGGGGS\EPKSSDKTHTCPPCPAPPVAGP
SVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLS
LSPGK* (SEQ ID NO:88)

Figure 22B

>XenD24756 human_IL12p40_N103D/N113D/N200D/N281D_(GGGGS)2-Fc(216)_IgG1_pI(-
)_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTC
HKGGEVLSHSLLLLHKKEDGIWSTDILKDQKEPKDKTFLRCEAKDYSGRFTCWWLTTISTDLTFSVKS
SRGSSDPQGVTCGAATLSAERVRGDNKEYEYSVECQEDSACPAAEESLPIEVMVDAVHKLKYEDYTSS
FFIRDIIKPDPPKNLQLKPLKNSRQVEVSWEYPDTWSTPHSYFSLTFCVQVQGKSKREKKDRVFTDKT
SATVICRKDASISVRAQDRYYSSSWSEWASVPCS\GGGGSGGGGS\EPKSSDKTHTCPPCPAPPVAGP
SVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLS
LSPGK (SEQ ID NO:89)

>XenD24757 human_IL12p40_Q42E_(GGGGS)2-Fc(216)_IgG1_pI(-
)_Isosteric_A_C220S/PVA_/S267K/L368D/K370S_pTT5
IWELKKDVYVVELDWYPDAPGEMVVLTCDTPEEDGITWTLDESSEVLGSGKTLTIQVKEFGDAGQYTC
HKGGEVLSHSLLLLHKKEDGIWSTDILKDQKEPKNKTFLRCEAKNYSGRFTCWWLTTISTDLTFSVKS
SRGSSDPQGVTCGAATLSAERVRGDNKEYEYSVECQEDSACPAAEESLPIEVMVDAVHKLKYENYTSS
FFIRDIIKPDPPKNLQLKPLKNSRQVEVSWEYPDTWSTPHSYFSLTFCVQVQGKSKREKKDRVFTDKT
SATVICRKNASISVRAQDRYYSSSWSEWASVPCS\GGGGSGGGGS\EPKSSDKTHTCPPCPAPPVAGP
SVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLS
LSPGK (SEQ ID NO:90)

>XenD24758 human_IL12p40_E45Q_(GGGGS)2-Fc(216)_IgG1_pI(-
)_Isosteric_A_C220S/PVA_/S267K/L368D/K370S_pTT5
IWELKKDVYVVELDWYPDAPGEMVVLTCDTPEEDGITWTLDQSSQVLGSGKTLTIQVKEFGDAGQYTC
HKGGEVLSHSLLLLHKKEDGIWSTDILKDQKEPKNKTFLRCEAKNYSGRFTCWWLTTISTDLTFSVKS
SRGSSDPQGVTCGAATLSAERVRGDNKEYEYSVECQEDSACPAAEESLPIEVMVDAVHKLKYENYTSS
FFIRDIIKPDPPKNLQLKPLKNSRQVEVSWEYPDTWSTPHSYFSLTFCVQVQGKSKREKKDRVFTDKT
SATVICRKNASISVRAQDRYYSSSWSEWASVPCS\GGGGSGGGGS\EPKSSDKTHTCPPCPAPPVAGP
SVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLS
LSPGK (SEQ ID NO:91)

>XenD24759 human_IL12p40_Q56E_(GGGGS)2-Fc(216)_IgG1_pI(-
)_Isosteric_A_C220S/PVA_/S267K/L368D/K370S_pTT5
IWELKKDVYVVELDWYPDAPGEMVVLTCDTPEEDGITWTLDQSSEVLGSGKTLTIEVKEFGDAGQYTC
HKGGEVLSHSLLLLHKKEDGIWSTDILKDQKEPKNKTFLRCEAKNYSGRFTCWWLTTISTDLTFSVKS
SRGSSDPQGVTCGAATLSAERVRGDNKEYEYSVECQEDSACPAAEESLPIEVMVDAVHKLKYENYTSS
FFIRDIIKPDPPKNLQLKPLKNSRQVEVSWEYPDTWSTPHSYFSLTFCVQVQGKSKREKKDRVFTDKT
SATVICRKNASISVRAQDRYYSSSWSEWASVPCS\GGGGSGGGGS\EPKSSDKTHTCPPCPAPPVAGP
SVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLS
LSPGK (SEQ ID NO:92)

Figure 22C

\>XenD24760 human_IL12p40_E59Q_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPEEDGITWTLDQSSEVLGSGKTLTIQVKQFGDAGQYTC
HKGGEVLSHSLLLLHKKEDGIWSTDILKDQKEPKNKTFLRCEAKNYSGRFTCWWLTTISTDLTFSVKS
SRGSSDPQGVTCGAATLSAERVRGDNKEYEYSVECQEDSACPAAEESLPIEVMVDAVHKLKYENYTSS
FFIRDIIKPDPPKNLQLKPLKNSRQVEVSWEYPDTWSTPHSYFSLTFCVQVQGKSKREKKDRVFTDKT
SATVICRKNASISVRAQDRYYSSSWSEWASVPCS\GGGGSGGGGS\EPKSSDKTHTCPPCPAPPVAGP
SVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLS
LSPGK* (SEQ ID NO:93)

\>XenD24761 human_IL12p40_D62N_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPEEDGITWTLDQSSEVLGSGKTLTIQVKEFGNAGQYTC
HKGGEVLSHSLLLLHKKEDGIWSTDILKDQKEPKNKTFLRCEAKNYSGRFTCWWLTTISTDLTFSVKS
SRGSSDPQGVTCGAATLSAERVRGDNKEYEYSVECQEDSACPAAEESLPIEVMVDAVHKLKYENYTSS
FFIRDIIKPDPPKNLQLKPLKNSRQVEVSWEYPDTWSTPHSYFSLTFCVQVQGKSKREKKDRVFTDKT
SATVICRKNASISVRAQDRYYSSSWSEWASVPCS\GGGGSGGGGS\EPKSSDKTHTCPPCPAPPVAGP
SVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLS
LSPGK* (SEQ ID NO:94)

\>XenD24762 human_IL12p40_Q42E/E45Q_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPEEDGITWTLDESSQVLGSGKTLTIQVKEFGDAGQYTC
HKGGEVLSHSLLLLHKKEDGIWSTDILKDQKEPKNKTFLRCEAKNYSGRFTCWWLTTISTDLTFSVKS
SRGSSDPQGVTCGAATLSAERVRGDNKEYEYSVECQEDSACPAAEESLPIEVMVDAVHKLKYENYTSS
FFIRDIIKPDPPKNLQLKPLKNSRQVEVSWEYPDTWSTPHSYFSLTFCVQVQGKSKREKKDRVFTDKT
SATVICRKNASISVRAQDRYYSSSWSEWASVPCS\GGGGSGGGGS\EPKSSDKTHTCPPCPAPPVAGP
SVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLS
LSPGK* (SEQ ID NO:95)

\>XenD24763 human_IL12p40_E45Q/Q56E_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPEEDGITWTLDQSSQVLGSGKTLTIEVKEFGDAGQYTC
HKGGEVLSHSLLLLHKKEDGIWSTDILKDQKEPKNKTFLRCEAKNYSGRFTCWWLTTISTDLTFSVKS
SRGSSDPQGVTCGAATLSAERVRGDNKEYEYSVECQEDSACPAAEESLPIEVMVDAVHKLKYENYTSS
FFIRDIIKPDPPKNLQLKPLKNSRQVEVSWEYPDTWSTPHSYFSLTFCVQVQGKSKREKKDRVFTDKT
SATVICRKNASISVRAQDRYYSSSWSEWASVPCS\GGGGSGGGGS\EPKSSDKTHTCPPCPAPPVAGP
SVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLS
LSPGK* (SEQ ID NO:96)

Figure 22D

>XenD24764 human_IL12p40_Q42E/E59Q_(GGGGS)2-Fc(216)_IgG1_pI(-
)_Isosteric_A_C220S/PVA_/S267K/L368D/K370S_pTT5
*IWELKKDVYVVELDWYPDAPGEMVVLTCDTPEEDGITWTLDESSEVLGSGKTLTIQVKQFGDAGQYTC
HKGGEVLSHSLLLLHKKEDGIWSTDILKDQKEPKNKTFLRCEAKNYSGRFTCWWLTTISTDLTFSVKS
SRGSSDPQGVTCGAATLSAERVRGDNKEYEYSVECQEDSACPAAEESLPIEVMVDAVHKLKYENYTSS
FFIRDIIKPDPPKNLQLKPLKNSRQVEVSWEYPDTWSTPHSYFSLTFCVQVQGKSKREKKDRVFTDKT
SATVICRKNASISVRAQDRYYSSSWSEWASVPCS\GGGGSGGGGS\EPKSSDKTHTCPPCPAPPVAGP
SVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLS
LSPGK* (SEQ ID NO:97)

>XenD24765 human_IL12p40_Q56E/E59Q_(GGGGS)2-Fc(216)_IgG1_pI(-
)_Isosteric_A_C220S/PVA_/S267K/L368D/K370S_pTT5
*IWELKKDVYVVELDWYPDAPGEMVVLTCDTPEEDGITWTLDQSSEVLGSGKTLTIEVKQFGDAGQYTC
HKGGEVLSHSLLLLHKKEDGIWSTDILKDQKEPKNKTFLRCEAKNYSGRFTCWWLTTISTDLTFSVKS
SRGSSDPQGVTCGAATLSAERVRGDNKEYEYSVECQEDSACPAAEESLPIEVMVDAVHKLKYENYTSS
FFIRDIIKPDPPKNLQLKPLKNSRQVEVSWEYPDTWSTPHSYFSLTFCVQVQGKSKREKKDRVFTDKT
SATVICRKNASISVRAQDRYYSSSWSEWASVPCS\GGGGSGGGGS\EPKSSDKTHTCPPCPAPPVAGP
SVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLS
LSPGK* (SEQ ID NO:98)

>XenD24766 human_IL12p40_Q42E/E45Q/Q56E_(GGGGS)2-Fc(216)_IgG1_pI(-
)_Isosteric_A_C220S/PVA_/S267K/L368D/K370S_pTT5
*IWELKKDVYVVELDWYPDAPGEMVVLTCDTPEEDGITWTLDESSQVLGSGKTLTIEVKEFGDAGQYTC
HKGGEVLSHSLLLLHKKEDGIWSTDILKDQKEPKNKTFLRCEAKNYSGRFTCWWLTTISTDLTFSVKS
SRGSSDPQGVTCGAATLSAERVRGDNKEYEYSVECQEDSACPAAEESLPIEVMVDAVHKLKYENYTSS
FFIRDIIKPDPPKNLQLKPLKNSRQVEVSWEYPDTWSTPHSYFSLTFCVQVQGKSKREKKDRVFTDKT
SATVICRKNASISVRAQDRYYSSSWSEWASVPCS\GGGGSGGGGS\EPKSSDKTHTCPPCPAPPVAGP
SVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLS
LSPGK* (SEQ ID NO:99)

>XenD24767 human_IL12p40_E45Q/Q56E/E59Q_(GGGGS)2-Fc(216)_IgG1_pI(-
)_Isosteric_A_C220S/PVA_/S267K/L368D/K370S_pTT5
*IWELKKDVYVVELDWYPDAPGEMVVLTCDTPEEDGITWTLDQSSQVLGSGKTLTIEVKQFGDAGQYTC
HKGGEVLSHSLLLLHKKEDGIWSTDILKDQKEPKNKTFLRCEAKNYSGRFTCWWLTTISTDLTFSVKS
SRGSSDPQGVTCGAATLSAERVRGDNKEYEYSVECQEDSACPAAEESLPIEVMVDAVHKLKYENYTSS
FFIRDIIKPDPPKNLQLKPLKNSRQVEVSWEYPDTWSTPHSYFSLTFCVQVQGKSKREKKDRVFTDKT
SATVICRKNASISVRAQDRYYSSSWSEWASVPCS\GGGGSGGGGS\EPKSSDKTHTCPPCPAPPVAGP
SVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLS
LSPGK* (SEQ ID NO:100)

Figure 22E

>XenD24768 human_IL12p40_D161N_(GGGGS)2-Fc(216)_IgG1_pI(-
)_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTC
HKGGEVLSHSLLLLHKKEDGIWSTDILKDQKEPKNKTFLRCEAKNYSGRFTCWWLTTISTDLTFSVKS
SRGSSDPQGVTCGAATLSAERVRGNNKEYEYSVECQEDSACPAAEESLPIEVMVDAVHKLKYENYTSS
FFIRDIIKPDPPKNLQLKPLKNSRQVEVSWEYPDTWSTPHSYFSLTFCVQVQGKSKREKKDRVFTDKT
SATVICRKNASISVRAQDRYYSSSWSEWASVPCS\GGGGSGGGGS\EPKSSDKTHTCPPCPAPPVAGP
SVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLS
LSPGK (SEQ ID NO:101)

>XenD24769 human_IL12p40_E73Q_(GGGGS)2-Fc(216)_IgG1_pI(-
)_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTC
HKGGQVLSHSLLLLHKKEDGIWSTDILKDQKEPKNKTFLRCEAKNYSGRFTCWWLTTISTDLTFSVKS
SRGSSDPQGVTCGAATLSAERVRGDNKEYEYSVECQEDSACPAAEESLPIEVMVDAVHKLKYENYTSS
FFIRDIIKPDPPKNLQLKPLKNSRQVEVSWEYPDTWSTPHSYFSLTFCVQVQGKSKREKKDRVFTDKT
SATVICRKNASISVRAQDRYYSSSWSEWASVPCS\GGGGSGGGGS\EPKSSDKTHTCPPCPAPPVAGP
SVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLS
LSPGK (SEQ ID NO:102)

>XenD24770 human_IL12p40_Q144E_(GGGGS)2-Fc(216)_IgG1_pI(-
)_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTC
HKGGEVLSHSLLLLHKKEDGIWSTDILKDQKEPKNKTFLRCEAKNYSGRFTCWWLTTISTDLTFSVKS
SRGSSDPEGVTCGAATLSAERVRGDNKEYEYSVECQEDSACPAAEESLPIEVMVDAVHKLKYENYTSS
FFIRDIIKPDPPKNLQLKPLKNSRQVEVSWEYPDTWSTPHSYFSLTFCVQVQGKSKREKKDRVFTDKT
SATVICRKNASISVRAQDRYYSSSWSEWASVPCS\GGGGSGGGGS\EPKSSDKTHTCPPCPAPPVAGP
SVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLS
LSPGK (SEQ ID NO:103)

>XenD24771 human_IL12p40_E262Q_(GGGGS)2-Fc(216)_IgG1_pI(-
)_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTC
HKGGEVLSHSLLLLHKKEDGIWSTDILKDQKEPKNKTFLRCEAKNYSGRFTCWWLTTISTDLTFSVKS
SRGSSDPQGVTCGAATLSAERVRGDNKEYEYSVECQEDSACPAAEESLPIEVMVDAVHKLKYENYTSS
FFIRDIIKPDPPKNLQLKPLKNSRQVEVSWEYPDTWSTPHSYFSLTFCVQVQGKSKRQKKDRVFTDKT
SATVICRKNASISVRAQDRYYSSSWSEWASVPCS\GGGGSGGGGS\EPKSSDKTHTCPPCPAPPVAGP
SVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLS
LSPGK (SEQ ID NO:104)

Figure 22F

>XenD24772 human_IL12p40_E100Q_(GGGGS)2-Fc(216)_IgG1_pI(-)_Isosteric_A_C220S/PVA_/S267K/L368D/K370S_pTT5
*IWELKKDVYVVELDWYPDAPGEMVVLTCDTPEEDGITWTLDQSSEVLGSGKTLTIQVKEFGDAGQYTC*
*HKGGEVLSHSLLLLHKKEDGIWSTDILKDQKQPKNKTFLRCEAKNYSGRFTCWWLTTISTDLTFSVKS*
*SRGSSDPQGVTCGAATLSAERVRGDNKEYEYSVECQEDSACPAAEESLPIEVMVDAVHKLKYENYTSS*
*FFIRDIIKPDPPKNLQLKPLKNSRQVEVSWEYPDTWSTPHSYFSLTFCVQVQGKSKREKKDRVFTDKT*
*SATVICRKNASISVRAQDRYYSSSWSEWASVPCS\GGGGSGGGGS\EPKSSDKTHTCPPCPAPPVAGP*
*SVFLFPPKPKDTLMISRTPEVTCVVVDVKHEDPEVKFNWYVDGVEVHNAKTKPREEEYNSTYRVVSVL*
*TVLHQDWLNGKEYKCKVSNKALPAPIEKTISKAKGQPREPQVYTLPPSREEMTKNQVSLTCDVSGFYP*
*SDIAVEWESDGQPENNYKTTPPVLDSDGSFFLYSKLTVDKSRWEQGDVFSCSVMHEALHNHYTQKSLS*
*LSPGK* (SEQ ID NO:105)

>XenD24773 human_IL12p40_D18N_(GGGGS)2-Fc(216)_IgG1_pI(-)_Isosteric_A_C220S/PVA_/S267K/L368D/K370S_pTT5
*IWELKKDVYVVELDWYPNAPGEMVVLTCDTPEEDGITWTLDQSSEVLGSGKTLTIQVKEFGDAGQYTC*
*HKGGEVLSHSLLLLHKKEDGIWSTDILKDQKEPKNKTFLRCEAKNYSGRFTCWWLTTISTDLTFSVKS*
*SRGSSDPQGVTCGAATLSAERVRGDNKEYEYSVECQEDSACPAAEESLPIEVMVDAVHKLKYENYTSS*
*FFIRDIIKPDPPKNLQLKPLKNSRQVEVSWEYPDTWSTPHSYFSLTFCVQVQGKSKREKKDRVFTDKT*
*SATVICRKNASISVRAQDRYYSSSWSEWASVPCS\GGGGSGGGGS\EPKSSDKTHTCPPCPAPPVAGP*
*SVFLFPPKPKDTLMISRTPEVTCVVVDVKHEDPEVKFNWYVDGVEVHNAKTKPREEEYNSTYRVVSVL*
*TVLHQDWLNGKEYKCKVSNKALPAPIEKTISKAKGQPREPQVYTLPPSREEMTKNQVSLTCDVSGFYP*
*SDIAVEWESDGQPENNYKTTPPVLDSDGSFFLYSKLTVDKSRWEQGDVFSCSVMHEALHNHYTQKSLS*
*LSPGK* (SEQ ID NO:106)

>XenD24774 human_IL12p40_E33Q_(GGGGS)2-Fc(216)_IgG1_pI(-)_Isosteric_A_C220S/PVA_/S267K/L368D/K370S_pTT5
*IWELKKDVYVVELDWYPDAPGEMVVLTCDTPEQDGITWTLDQSSEVLGSGKTLTIQVKEFGDAGQYTC*
*HKGGEVLSHSLLLLHKKEDGIWSTDILKDQKEPKNKTFLRCEAKNYSGRFTCWWLTTISTDLTFSVKS*
*SRGSSDPQGVTCGAATLSAERVRGDNKEYEYSVECQEDSACPAAEESLPIEVMVDAVHKLKYENYTSS*
*FFIRDIIKPDPPKNLQLKPLKNSRQVEVSWEYPDTWSTPHSYFSLTFCVQVQGKSKREKKDRVFTDKT*
*SATVICRKNASISVRAQDRYYSSSWSEWASVPCS\GGGGSGGGGS\EPKSSDKTHTCPPCPAPPVAGP*
*SVFLFPPKPKDTLMISRTPEVTCVVVDVKHEDPEVKFNWYVDGVEVHNAKTKPREEEYNSTYRVVSVL*
*TVLHQDWLNGKEYKCKVSNKALPAPIEKTISKAKGQPREPQVYTLPPSREEMTKNQVSLTCDVSGFYP*
*SDIAVEWESDGQPENNYKTTPPVLDSDGSFFLYSKLTVDKSRWEQGDVFSCSVMHEALHNHYTQKSLS*
*LSPGK* (SEQ ID NO:107)

>XenD24775 human_IL12p40_Q229E_(GGGGS)2-Fc(216)_IgG1_pI(-)_Isosteric_A_C220S/PVA_/S267K/L368D/K370S_pTT5
*IWELKKDVYVVELDWYPDAPGEMVVLTCDTPEEDGITWTLDQSSEVLGSGKTLTIQVKEFGDAGQYTC*
*HKGGEVLSHSLLLLHKKEDGIWSTDILKDQKEPKNKTFLRCEAKNYSGRFTCWWLTTISTDLTFSVKS*
*SRGSSDPQGVTCGAATLSAERVRGDNKEYEYSVECQEDSACPAAEESLPIEVMVDAVHKLKYENYTSS*
*FFIRDIIKPDPPKNLQLKPLKNSREVEVSWEYPDTWSTPHSYFSLTFCVQVQGKSKREKKDRVFTDKT*
*SATVICRKNASISVRAQDRYYSSSWSEWASVPCS\GGGGSGGGGS\EPKSSDKTHTCPPCPAPPVAGP*
*SVFLFPPKPKDTLMISRTPEVTCVVVDVKHEDPEVKFNWYVDGVEVHNAKTKPREEEYNSTYRVVSVL*
*TVLHQDWLNGKEYKCKVSNKALPAPIEKTISKAKGQPREPQVYTLPPSREEMTKNQVSLTCDVSGFYP*
*SDIAVEWESDGQPENNYKTTPPVLDSDGSFFLYSKLTVDKSRWEQGDVFSCSVMHEALHNHYTQKSLS*
*LSPGK* (SEQ ID NO:108)

Figure 22G

\>XenD24776_human_IL12p40_E235Q_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPEEDGITWTLDQSSEVLGSGKTLTIQVKEFGDAGQYTC
HKGGEVLSHSLLLLHKKEDGIWSTDILKDQKEPKNKTFLRCEAKNYSGRFTCWWLTTISTDLTFSVKS
SRGSSDPQGVTCGAATLSAERVRGDNKEYEYSVECQEDSACPAAEESLPIEVMVDAVHKLKYENYTSS
FFIRDIIKPDPPKNLQLKPLKNSRQVEVSWQYPDTWSTPHSYFSLTFCVQVQGKSKREKKDRVFTDKT
SATVICRKNASISVRAQDRYYSSSWSEWASVPCS\GGGGSGGGGS\EPKSSDKTHTCPPCPAPPVAGP
SVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLS
LSPGK* (SEQ ID NO:109)

\>XenD24777_human_IL12p40_Q256E_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPEEDGITWTLDQSSEVLGSGKTLTIQVKEFGDAGQYTC
HKGGEVLSHSLLLLHKKEDGIWSTDILKDQKEPKNKTFLRCEAKNYSGRFTCWWLTTISTDLTFSVKS
SRGSSDPQGVTCGAATLSAERVRGDNKEYEYSVECQEDSACPAAEESLPIEVMVDAVHKLKYENYTSS
FFIRDIIKPDPPKNLQLKPLKNSRQVEVSWEYPDTWSTPHSYFSLTFCVQVEGKSKREKKDRVFTDKT
SATVICRKNASISVRAQDRYYSSSWSEWASVPCS\GGGGSGGGGS\EPKSSDKTHTCPPCPAPPVAGP
SVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLS
LSPGK* (SEQ ID NO:110)

\>XenD24778_human_IL12p40_E299Q_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPEEDGITWTLDQSSEVLGSGKTLTIQVKEFGDAGQYTC
HKGGEVLSHSLLLLHKKEDGIWSTDILKDQKEPKNKTFLRCEAKNYSGRFTCWWLTTISTDLTFSVKS
SRGSSDPQGVTCGAATLSAERVRGDNKEYEYSVECQEDSACPAAEESLPIEVMVDAVHKLKYENYTSS
FFIRDIIKPDPPKNLQLKPLKNSRQVEVSWEYPDTWSTPHSYFSLTFCVQVQGKSKREKKDRVFTDKT
SATVICRKNASISVRAQDRYYSSSWSQWASVPCS\GGGGSGGGGS\EPKSSDKTHTCPPCPAPPVAGP
SVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLS
LSPGK* (SEQ ID NO:111)

\>XenD24792_human_IL12p40_D87N_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPEEDGITWTLDQSSEVLGSGKTLTIQVKEFGDAGQYTC
HKGGEVLSHSLLLLHKKENGIWSTDILKDQKEPKNKTFLRCEAKNYSGRFTCWWLTTISTDLTFSVKS
SRGSSDPQGVTCGAATLSAERVRGDNKEYEYSVECQEDSACPAAEESLPIEVMVDAVHKLKYENYTSS
FFIRDIIKPDPPKNLQLKPLKNSRQVEVSWEYPDTWSTPHSYFSLTFCVQVQGKSKREKKDRVFTDKT
SATVICRKNASISVRAQDRYYSSSWSEWASVPCS\GGGGSGGGGS\EPKSSDKTHTCPPCPAPPVAGP
SVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLS
LSPGK* (SEQ ID NO:112)

Figure 23

| Residue | ASA |
|---|---|
| Q35 | 134 |
| E38 | 159 |
| E46 | 145 |
| D55 | 159 |
| E67 | 140 |
| N71 | 103 |
| N76 | 119 |
| N85 | 151 |
| Q135 | 138 |
| Q146 | 124 |
| N151 | 144 |
| E153 | 189 |
| E162 | 114 |
| E163 | 112 |

Figure 24A

> IL-12p35(N71D)
RNLPVATPDPGMFPCLHHSQNLLRAVSNMLQKARQTLEFYPCTSEEIDHEDITKDKTSTVEACLPLELTK<u>D</u>ESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS (SEQ ID NO:113)

> IL-12p35(N85D)
RNLPVATPDPGMFPCLHHSQNLLRAVSNMLQKARQTLEFYPCTSEEIDHEDITKDKTSTVEACLPLELTKNESCL
NSRETSFIT<u>D</u>GSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS (SEQ ID NO:114)

> IL-12p35(N195D)
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYL<u>D</u>AS (SEQ ID NO:115)

> IL-12p35(N71D/N85D/N195D)
RNLPVATPDPGMFPCLHHSQNLLRAVSNMLQKARQTLEFYPCTSEEIDHEDITKDKTSTVEACLPLELTK<u>D</u>ESCL
NSRETSFIT<u>D</u>GSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYL<u>D</u>AS (SEQ ID NO:116)

> IL-12p35(E153Q)
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NS<u>Q</u>TVPQKSSLEEPDFYKTKIKLCILLHAFRIRAVTIDRVMSYLNAS (SEQ ID NO:117)

> IL-12p35(E38Q)
RNLPVATPDPGMFPCLHHSQNLLRAVSNMLQKARQTL<u>Q</u>FYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS (SEQ ID NO:118)

> IL-12p35(N151D)
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
<u>D</u>SETVPQKSSLEEPDFYKTKIKLCILLHAFRIRAVTIDRVMSYLNAS (SEQ ID NO:119)

> IL-12p35(Q135E)
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLD<u>E</u>NMLAVIDELMQALNF
NSETVPQKSSLEEPDFYKTKIKLCILLHAFRIRAVTIDRVMSYLNAS (SEQ ID NO:120)

Figure 24B

> IL-12p35(Q35D)
RNLPVATPDPGMFPCLHHSQNLLRAVSNMLQKARDTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS (SEQ ID NO:121)

> IL-12p35(Q146E)
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMEALNF
NSETVPQKSSLEEPDFYKTKIKLCILLHAFRIRAVTIDRVMSYLNAS (SEQ ID NO:122)

> IL-12p35(N76D)
RNLPVATPDPGMFPCLHHSQNLLRAVSNMLQKARQTLEFYPCTSEEIDHEDITKDKTSTVEACLPLELTKNESCL
DSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS (SEQ ID NO:123)

> IL-12p35(E162Q)
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLQEPDFYKTKIKLCILLHAFRIRAVTIDRVMSYLNAS (SEQ ID NO:124)

> IL-12p35(E163Q)
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEQPDFYKTKIKLCILLHAFRIRAVTIDRVMSYLNAS (SEQ ID NO:125)

> IL-12p35(N71Q)
RNLPVATPDPGMFPCLHHSQNLLRAVSNMLQKARQTLEFYPCTSEEIDHEDITKDKTSTVEACLPLELTKQESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS (SEQ ID NO:279)

> IL-12p35(N85Q)
RNLPVATPDPGMFPCLHHSQNLLRAVSNMLQKARQTLEFYPCTSEEIDHEDITKDKTSTVEACLPLELTKNESCL
NSRETSFITQGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS (SEQ ID NO:280)

> IL-12p35(N195Q)
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLQAS (SEQ ID NO:281)

> IL-12p35(N71Q/N85Q)
RNLPVATPDPGMFPCLHHSQNLLRAVSNMLQKARQTLEFYPCTSEEIDHEDITKDKTSTVEACLPLELTKQESCL
NSRETSFITQGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS (SEQ ID NO:282)

> IL-12p35(N71Q/N195Q)
RNLPVATPDPGMFPCLHHSQNLLRAVSNMLQKARQTLEFYPCTSEEIDHEDITKDKTSTVEACLPLELTKQESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLQAS (SEQ ID NO:283)

Figure 24C

> IL-12p35(N85Q/N195Q)
RNLPVATPDPGMFPCLHHSQNLLRAVSNMLQKARQTLEFYPCTSEEIDHEDITKDKTSTVEACLPLELTKNESCL
NSRETSFITQGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLQAS (SEQ ID NO:284)

> IL-12p35(N71Q/N85Q/N195Q)
RNLPVATPDPGMFPCLHHSQNLLRAVSNMLQKARQTLEFYPCTSEEIDHEDITKDKTSTVEACLPLELTKQESCL
NSRETSFITQGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLQAS (SEQ ID NO:285)

> IL-12p35(N71D/N85D)
RNLPVATPDPGMFPCLHHSQNLLRAVSNMLQKARQTLEFYPCTSEEIDHEDITKDKTSTVEACLPLELTKDESCL
NSRETSFITDGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS (SEQ ID NO:286)

> IL-12p35(N71D/N195D)
RNLPVATPDPGMFPCLHHSQNLLRAVSNMLQKARQTLEFYPCTSEEIDHEDITKDKTSTVEACLPLELTKDESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLDAS (SEQ ID NO:287)

> IL-12p35(N85D/N195D)
RNLPVATPDPGMFPCLHHSQNLLRAVSNMLQKARQTLEFYPCTSEEIDHEDITKDKTSTVEACLPLELTKNESCL
NSRETSFITDGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLDAS (SEQ ID NO:288)

Figure 25A

>XenD24779 human_IL12p35_N71D_(GGGGS)2_Fc(216)_IgG1_C220S/PVA_/S267K/S364K/E357Q_pTT5
*RNLPVATPDPGMFPCLHHSQNLLRAVSNMLQKARQTLEFYPCTSEEIDHEDITKDKTSTVEACLPLELTKDESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:126)

>XenD24780 human_IL12p35_N85D_(GGGGS)2_Fc(216)_IgG1_C220S/PVA_/S267K/S364K/E357Q_pTT5
*RNLPVATPDPGMFPCLHHSQNLLRAVSNMLQKARQTLEFYPCTSEEIDHEDITKDKTSTVEACLPLELTKNESCL
NSRETSFITDGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:127)

>XenD24781 human_IL12p35_N195D_(GGGGS)2_Fc(216)_IgG1_C220S/PVA_/S267K/S364K/E357Q_pTT5
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLDAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:128)

**>XenD24782
human_IL12p35_N71D/N85D/N195D_(GGGGS)2_Fc(216)_IgG1_C220S/PVA_/S267K/S364K/E357Q_pTT5**
*RNLPVATPDPGMFPCLHHSQNLLRAVSNMLQKARQTLEFYPCTSEEIDHEDITKDKTSTVEACLPLELTKDESCL
NSRETSFITDGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLDAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:129)

>XenD24783 human_IL12p35_E153Q_(GGGGS)2_Fc(216)_IgG1_C220S/PVA_/S267K/S364K/E357Q_pTT5
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSQTVPQKSSLEEPDFYKTKIKLCILLHAFRIRAVTIDRVMSYLNAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:130)

>XenD24784 human_IL12p35_E38Q_(GGGGS)2_Fc(216)_IgG1_C220S/PVA_/S267K/S364K/E357Q_pTT5
*RNLPVATPDPGMFPCLHHSQNLLRAVSNMLQKARQTLQFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:131)

Figure 25B

>XenD24785 human IL12p35 N151D (GGGGS)2 Fc(216) IgG1 C220S/PVA /S267K/S364K/E357Q pTT5
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
DSETVPQKSSLEEPDFYKTKIKLCILLHAFRIRAVTIDRVMSYLNAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:132)

>XenD24786 human IL12p35 Q135E (GGGGS)2 Fc(216) IgG1 C220S/PVA /S267K/S364K/E357Q pTT5
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDENMLAVIDELMQALNF
NSETVPQKSSLEEPDFYKTKIKLCILLHAFRIRAVTIDRVMSYLNAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:133)

>XenD24787 human IL12p35 Q35D (GGGGS)2 Fc(216) IgG1 C220S/PVA /S267K/S364K/E357Q pTT5
*RNLPVATPDPGMFPCLHHSQNLLRAVSNMLQKARDTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:134)

>XenD24788 human IL12p35 Q146E (GGGGS)2 Fc(216) IgG1 C220S/PVA /S267K/S364K/E357Q pTT5
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMEALNF
NSETVPQKSSLEEPDFYKTKIKLCILLHAFRIRAVTIDRVMSYLNAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:135)

>XenD24789 human IL12p35 N76D (GGGGS)2 Fc(216) IgG1 C220S/PVA /S267K/S364K/E357Q pTT5
*RNLPVATPDPGMFPCLHHSQNLLRAVSNMLQKARQTLEFYPCTSEEIDHEDITKDKTSTVEACLPLELTKNESCL
DSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:136)

>XenD24790 human IL12p35 E162Q (GGGGS)2 Fc(216) IgG1 C220S/PVA /S267K/S364K/E357Q pTT5
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLQEPDFYKTKIKLCILLHAFRIRAVTIDRVMSYLNAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:137)

Figure 25C

>XenD24791_human_IL12p35_E163Q_(GGGGS)2_Fc(216)_IgG1_C220S/PVA_/S267K/S364K/E357Q_pTT5
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEQPDFYKTKIKLCILLHAFRIRAVTIDRVMSYLNAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK (SEQ ID
NO:138)

Figure 26A

>XENP28820 human_IL12p40(N103D/N113D/N200D/N281D)_(GGGGS)2-
human_IL12p35(N71D/N85D/N195D)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD24756) - human_IL12p40_N103D/N113D/N200D/N281D_(GGGGS)2-Fc(216)_IgG1_pI(-
)_Isosteric_A_C220S/PVA_/S267K/L368D/K370S
*IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKDKTFLRCEAKDYSGRFTCWWLTTISTDLTFSVKSSRGSSDPQGVTCGA
ATLSAERVRGDNKEYEYSVECQEDSACPAAEESLPIEVMVDAVHKLKYEDYTSSFFIRDIIKPDPPKNLQLKPLK
NSRQVEVSWEYPDTWSTPHSYFSLTFCVQVQGKSKREKKDRVFTDKTSATVICRKDASISVRAQDRYYSSSWSEW
ASVPCS\*GGGGSGGGGS\*EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:139)

Chain 2 (XenD24782) -
human_IL12p35_N71D/N85D/N195D_(GGGGS)2_Fc(216)_IgG1_C220S/PVA_/S267K/S364K/E357Q
*RNLPVATPDPGMFPCLHHSQNLLRAVSNMLQKARQTLEFYPCTSEEIDHEDITKDKTSTVEACLPLELTKDESCL
NSRETSFITDGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLDAS\*GGGGSGGGGS\*EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* **(SEQ ID
NO:140)**

>XENP28821 human_IL12p40(D87N)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD24792) - human_IL12p40_D87N_(GGGGS)2-Fc(216)_IgG1_pI(-
)_Isosteric_A_C220S/PVA_/S267K/L368D/K370S
*IWELKKDVYVVELDWYPDAPGEMVVLTCDTPEEDGITWTLDQSSEVLGSGKTLTIQVKEFGDAGQYTCHKGGEVL
SHSLLLLHKKENGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS\*GGGGSGGGGS\*EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:141)

Chain 2 (XenD22915) - human_IL12p35_(GGGGS)2_Fc(216)_IgG1_C220S/PVA_/S267K/S364K/E357Q
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS\*GGGGSGGGGS\*EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* **(SEQ ID
NO:142)**

Figure 26B

>XENP28822_human_IL12p40(Q42E)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD24757) - human_IL12p40_Q42E_(GGGGS)2-Fc(216)_IgG1_pI(-)_Isosteric_A_C220S/PVA_/S267K/L368D/K370S

*IWELKKDVYVVELDWYPDAPGEMVVLTCDTPEEDGITWTLDESSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS*\GGGGSGGGGS\EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK (SEQ ID NO:143)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS*\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:144)

>XENP28823_human_IL12p40(E45Q)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD24758) - human_IL12p40_E45Q_(GGGGS)2-Fc(216)_IgG1_pI(-)_Isosteric_A_C220S/PVA_/S267K/L368D/K370S

*IWELKKDVYVVELDWYPDAPGEMVVLTCDTPEEDGITWTLDQSSQVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS*\GGGGSGGGGS\EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK (SEQ ID NO:145)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS*\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:146)

Figure 26C

>XENP28824 human_IL12p40(Q56E)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD24759) - human_IL12p40_Q56E_(GGGGS)2-Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIEVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS\GGGGSGGGGS\EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:147)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:148)

>XENP28825 human_IL12p40(E59Q)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD24760) - human_IL12p40_E59Q_(GGGGS)2-Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKQFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS\GGGGSGGGGS\EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:149)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:150)

Figure 26D

>XENP28826 human_IL12p40(D62N)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD24761) - human_IL12p40_D62N_(GGGGS)2-Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGNAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS\GGGGSGGGGS\EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:151)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:152)

>XENP28827 human_IL12p40(Q42E/E45Q)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD24762) - human_IL12p40_Q42E/E45Q_(GGGGS)2-Fc(216)_IgG1_pI(-)_Isosteric_A_C220S/PVA_/S267K/L368D/K370S

*IWELKKDVYVVELDWYPDAPGEMVVLTCDTPEEDGITWTLDESSQVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS\GGGGSGGGGS\EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:153)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:154)

Figure 26E

>XENP28828 human_IL12p40(E45Q/Q56E)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD24763) - human_IL12p40_E45Q/Q56E_(GGGGS)2-Fc(216)_IgG1_pI(-
)_Isosteric_A_C220S/PVA_/S267K/L368D/K370S
IWELKKDVYVVELDWYPDAPGEMVVLTCDTPEEDGITWTLDQSSQVLGSGKTLTIEVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS\GGGGSGGGGS\EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK (SEQ ID NO:155)

Chain 2 (XenD22915) - human_IL12p35_(GGGGS)2_Fc(216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK (SEQ ID
NO:156)

>XENP28829 human_IL12p40(Q42E/E59Q)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD24764) - human_IL12p40_Q42E/E59Q_(GGGGS)2-Fc(216)_IgG1_pI(-
)_Isosteric_A_C220S/PVA_/S267K/L368D/K370S
IWELKKDVYVVELDWYPDAPGEMVVLTCDTPEEDGITWTLDESSEVLGSGKTLTIQVKQFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS\GGGGSGGGGS\EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK (SEQ ID NO:157)

Chain 2 (XenD22915) - human_IL12p35_(GGGGS)2_Fc(216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK (SEQ ID
NO:158)

Figure 26F

>XENP28830 human_IL12p40(Q56E/E59Q)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

Chain 1 (XenD24765) - human_IL12p40_Q56E/E59Q_(GGGGS)2-Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIEVKQFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS\GGGGSGGGGS\EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:159)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:160)

>XENP28831 human_IL12p40(Q42E/E45Q/Q56E)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

Chain 1 (XenD24766) - human_IL12p40_Q42E/E45Q/Q56E_(GGGGS)2-Fc(216)_IgG1_pI(-)_Isosteric_A_C220S/PVA_/S267K/L368D/K370S

*IWELKKDVYVVELDWYPDAPGEMVVLTCDTPEEDGITWTLDESSQVLGSGKTLTIEVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS\GGGGSGGGGS\EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:161)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:162)

Figure 26G

>XENP28832 human_IL12p40(E45Q/Q56E/E59Q)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD24767) - human_IL12p40_E45Q/Q56E/E59Q_(GGGGS)2-Fc(216)_IgG1_pI(-)_Isosteric_A_C220S/PVA_/S267K/L368D/K370S

*IWELKKDVYVVELDWYPDAPGEMVVLTCDTPEEDGITWTLDQSSQVLGSGKTLTIEVKQFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS\GGGGSGGGGS\EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:163)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:164)

>XENP28833 human_IL12p40(D161N)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD24768) - human_IL12p40_D161N_(GGGGS)2-Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGNNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS\GGGGSGGGGS\EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:165)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:166)

Figure 26H

>XENP28834 human_IL12p40(E73Q)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD24769) - human_IL12p40_E73Q_(GGGGS)2-Fc(216)_IgG1_pI(-
)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGQVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS\GGGGSGGGGS\EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:167)

Chain 2 (XenD22915) - human_IL12p35_(GGGGS)2_Fc(216)_IgG1_C220S/PVA_/S267K/S364K/E357Q
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* **(SEQ ID
NO:168)**

>XENP28835 human_IL12p40(Q144E)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD24770) - human_IL12p40_Q144E_(GGGGS)2-Fc(216)_IgG1_pI(-
)_Isosteric_A_C220S/PVA_/S267K/L368D/K370S
*IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPEGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS\GGGGSGGGGS\EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:169)

Chain 2 (XenD22915) - human_IL12p35_(GGGGS)2_Fc(216)_IgG1_C220S/PVA_/S267K/S364K/E357Q
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* **(SEQ ID
NO:170)**

Figure 26I

>XENP28836 human_IL12p40(E262Q)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD24771) - human_IL12p40_E262Q_(GGGGS)2-Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVL SHSLLLLHKKEDGIWSTDILKDQKEPKNKTFLRCEAKNYSGRFTCWWLTTISTDLTFSVKSSRGSSDPQGVTCGA ATLSAERVRGDNKEYEYSVECQEDSACPAAEESLPIEVMVDAVHKLKYENYTSSFFIRDIIKPDPPKNLQLKPLK NSRQVEVSWEYPDTWSTPHSYFSLTFCVQVQGKSKRQKKDRVFTDKTSATVICRKNASISVRAQDRYYSSSWSEW ASVPCS\*GGGGSGGGGS\*EPKSSDKTHTCPPCPAPPVAGPSVFLFPPKPKDTLMISRTPEVTCVVVDVKHEDPEV KFNWYVDGVEVHNAKTKPREEEYNSTYRVVSVLTVLHQDWLNGKEYKCKVSNKALPAPIEKTISKAKGQPREPQV YTLPPSREEMTKNQVSLTCDVSGFYPSDIAVEWESDGQPENNYKTTPPVLDSDGSFFLYSKLTVDKSRWEQGDVF SCSVMHEALHNHYTQKSLSLSPGK* (SEQ ID NO:171)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL NSRETSFITNGSCLASRKTSFMMALCLSSIYEDLKMYQVEFKTMNAKLLMDPKRQIFLDQNMLAVIDELMQALNF NSETVPQKSSLEEPDFYKTKIKLCILLHAFRIRAVTIDRVMSYLNAS\*GGGGSGGGGS\*EPKSSDKTHTCPPCPA PPVAGPSVFLFPPKPKDTLMISRTPEVTCVVVDVKHEDPEVKFNWYVDGVEVHNAKTKPREEQYNSTYRVVSVLT VLHQDWLNGKEYKCKVSNKALPAPIEKTISKAKGQPREPQVYTLPPSREMTKNQVKLTCLVKGFYPSDIAVEWE SNGQPENNYKTTPPVLDSDGSFFLYSKLTVDKSRWQQGNVFSCSVMHEALHNHYTQKSLSLSPGK* (SEQ ID NO:172)

>XENP28837 human_IL12p40(E100Q)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD24772) - human_IL12p40_E100Q_(GGGGS)2-Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVL SHSLLLLHKKEDGIWSTDILKDQKQPKNKTFLRCEAKNYSGRFTCWWLTTISTDLTFSVKSSRGSSDPQGVTCGA ATLSAERVRGDNKEYEYSVECQEDSACPAAEESLPIEVMVDAVHKLKYENYTSSFFIRDIIKPDPPKNLQLKPLK NSRQVEVSWEYPDTWSTPHSYFSLTFCVQVQGKSKREKKDRVFTDKTSATVICRKNASISVRAQDRYYSSSWSEW ASVPCS\*GGGGSGGGGS\*EPKSSDKTHTCPPCPAPPVAGPSVFLFPPKPKDTLMISRTPEVTCVVVDVKHEDPEV KFNWYVDGVEVHNAKTKPREEEYNSTYRVVSVLTVLHQDWLNGKEYKCKVSNKALPAPIEKTISKAKGQPREPQV YTLPPSREEMTKNQVSLTCDVSGFYPSDIAVEWESDGQPENNYKTTPPVLDSDGSFFLYSKLTVDKSRWEQGDVF SCSVMHEALHNHYTQKSLSLSPGK* (SEQ ID NO:173)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL NSRETSFITNGSCLASRKTSFMMALCLSSIYEDLKMYQVEFKTMNAKLLMDPKRQIFLDQNMLAVIDELMQALNF NSETVPQKSSLEEPDFYKTKIKLCILLHAFRIRAVTIDRVMSYLNAS\*GGGGSGGGGS\*EPKSSDKTHTCPPCPA PPVAGPSVFLFPPKPKDTLMISRTPEVTCVVVDVKHEDPEVKFNWYVDGVEVHNAKTKPREEQYNSTYRVVSVLT VLHQDWLNGKEYKCKVSNKALPAPIEKTISKAKGQPREPQVYTLPPSREMTKNQVKLTCLVKGFYPSDIAVEWE SNGQPENNYKTTPPVLDSDGSFFLYSKLTVDKSRWQQGNVFSCSVMHEALHNHYTQKSLSLSPGK* (SEQ ID NO:174)

Figure 26J

>XENP28838 human_IL12p40(D18N)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD24773) - human_IL12p40_D18N_(GGGGS)2-Fc(216)_IgG1_pI(-
)_Isosteric_A_C220S/PVA_/S267K/L368D/K370S IWELKKDVYVVELDWYPNAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS\GGGGSGGGGS\EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK (SEQ ID NO:175)

Chain 2 (XenD22915) - human_IL12p35_(GGGGS)2_Fc(216)_IgG1_C220S/PVA_/S267K/S364K/E357Q RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK **(SEQ ID
NO:176)**

>XENP28839 human_IL12p40(E33Q)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD24774) - human_IL12p40_E33Q_(GGGGS)2-Fc(216)_IgG1_pI(-
)_Isosteric_A_C220S/PVA_/S267K/L368D/K370S IWELKKDVYVVELDWYPDAPGEMVVLTCDTPEQDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS\GGGGSGGGGS\EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK (SEQ ID NO:177)

Chain 2 (XenD22915) - human_IL12p35_(GGGGS)2_Fc(216)_IgG1_C220S/PVA_/S267K/S364K/E357Q RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK **(SEQ ID
NO:178)**

Figure 26K

>XENP28840 human_IL12p40(Q229E)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD24775) - human_IL12p40_Q229E_(GGGGS)2-Fc(216)_IgG1_pI(-)_Isosteric_A_C220S/PVA_/S267K/L368D/K370S
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSREVEVSWEYPDTWSTPHSYFSLTFCVQVQGKSKREKKDRVFTDKTSATVICRKNASISVRAQDRYYSSSWSEW
ASVPCS\GGGGSGGGGS\EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK (SEQ ID NO:179)

Chain 2 (XenD22915) - human_IL12p35_(GGGGS)2_Fc(216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:180)

>XENP28841 human_IL12p40(E235Q)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD24776) - human_IL12p40_E235Q_(GGGGS)2-Fc(216)_IgG1_pI(-)_Isosteric_A_C220S/PVA_/S267K/L368D/K370S
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWQYPDTWSTPHSYFSLTFCVQVQGKSKREKKDRVFTDKTSATVICRKNASISVRAQDRYYSSSWSEW
ASVPCS\GGGGSGGGGS\EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK (SEQ ID NO:181)

Chain 2 (XenD22915) - human_IL12p35_(GGGGS)2_Fc(216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:182)

Figure 26L

>XENP28842 human_IL12p40(Q256E)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD24777) - human_IL12p40_Q256E_(GGGGS)2-Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVEGKSKREKKDRVFTDKTSATVICRKNASISVRAQDRYYSSSWSEW
ASVPCS\GGGGSGGGGS\EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:183)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:184)

>XENP28843 human_IL12p40(E299Q)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD24778) - human_IL12p40_E299Q_(GGGGS)2-Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSQW
ASVPCS\GGGGSGGGGS\EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:185)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:186)

Figure 26M

>XENP28844 human_IL12p40_(GGGGS)2-human_IL12p35(E153Q)_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD22914) - human_IL12p40_(GGGGS)2-Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS\GGGGSGGGGS\EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:187)

Chain 2 (XenD24783) - human_IL12p35_E153Q_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSQTVPQKSSLEEPDFYKTKIKLCILLHAFRIRAVTIDRVMSYLNAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:188)

>XENP28845 human_IL12p40_(GGGGS)2-human_IL12p35(E38Q)_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD22914) - human_IL12p40_(GGGGS)2-Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS\GGGGSGGGGS\EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:189)

Chain 2 (XenD24784) - human_IL12p35_E38Q_(GGGGS)2_Fc(216)_IgG1_C220S/PVA_/S267K/S364K/E357Q

*RNLPVATPDPGMFPCLHHSQNLLRAVSNMLQKARQTLQFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:190)

Figure 26N

>XENP28846 human_IL12p40_(GGGGS)2-human_IL12p35(N151D)_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD22914) - human_IL12p40_(GGGGS)2-Fc(216)_IgG1_pI(-)_Isosteric_A_C220S/PVA_/S267K/L368D/K370S
*IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS\GGGGSGGGGS\EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:191)

Chain 2 (XenD24785) - human_IL12p35_N151D_(GGGGS)2_Fc(216)_IgG1_C220S/PVA_/S267K/S364K/E357Q
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
DSETVPQKSSLEEPDFYKTKIKLCILLHAFRIRAVTIDRVMSYLNAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:192)

>XENP28847 human_IL12p40_(GGGGS)2-human_IL12p35(Q135E)_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD22914) - human_IL12p40_(GGGGS)2-Fc(216)_IgG1_pI(-)_Isosteric_A_C220S/PVA_/S267K/L368D/K370S
*IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS\GGGGSGGGGS\EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:193)

Chain 2 (XenD24786) - human_IL12p35_Q135E_(GGGGS)2_Fc(216)_IgG1_C220S/PVA_/S267K/S364K/E357Q
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDENMLAVIDELMQALNF
NSETVPQKSSLEEPDFYKTKIKLCILLHAFRIRAVTIDRVMSYLNAS\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:194)

Figure 26O

>XENP28848 human_IL12p40_(GGGGS)2-human_IL12p35(Q35D)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD22914) - human_IL12p40_(GGGGS)2-Fc(216)_IgG1_pI(-
)_Isosteric_A_C220S/PVA_/S267K/L368D/K370S
*IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS\*GGGGSGGGGS\*EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:195)

Chain 2 (XenD24787) - human_IL12p35_Q35D_(GGGGS)2_Fc(216)_IgG1_C220S/PVA_/S267K/S364K/E357Q
*RNLPVATPDPGMFPCLHHSQNLLRAVSNMLQKARDTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS\*GGGGSGGGGS\*EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* **(SEQ ID
NO:196)**

>XENP28849 human_IL12p40_(GGGGS)2-human_IL12p35(Q146E)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD22914) - human_IL12p40_(GGGGS)2-Fc(216)_IgG1_pI(-
)_Isosteric_A_C220S/PVA_/S267K/L368D/K370S
*IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS\*GGGGSGGGGS\*EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:197)

Chain 2 (XenD24788) - human_IL12p35_Q146E_(GGGGS)2_Fc(216)_IgG1_C220S/PVA_/S267K/S364K/E357Q
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMEALNF
NSETVPQKSSLEEPDFYKTKIKLCILLHAFRIRAVTIDRVMSYLNAS\*GGGGSGGGGS\*EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* **(SEQ ID
NO:198)**

Figure 26P

>XENP28850 human_IL12p40_(GGGGS)2-human_IL12p35(N76D)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD22914) - human_IL12p40_(GGGGS)2-Fc(216)_IgG1_pI(-
)_Isosteric_A_C220S/PVA_/S267K/L368D/K370S
*IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS*\GGGGSGGGGS\*EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:199)

Chain 2 (XenD24789) - human_IL12p35_N76D_(GGGGS)2_Fc(216)_IgG1_C220S/PVA_/S267K/S364K/E357Q
*RNLPVATPDPGMFPCLHHSQNLLRAVSNMLQKARQTLEFYPCTSEEIDHEDITKDKTSTVEACLPLELTKNESCL
DSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS*\GGGGSGGGGS\*EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* **(SEQ ID
NO:200)**

>XENP28851 human_IL12p40_(GGGGS)2-human_IL12p35(E162Q)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD22914) - human_IL12p40_(GGGGS)2-Fc(216)_IgG1_pI(-
)_Isosteric_A_C220S/PVA_/S267K/L368D/K370S
*IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS*\GGGGSGGGGS\*EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:201)

Chain 2 (XenD24790) - human_IL12p35_E162Q_(GGGGS)2_Fc(216)_IgG1_C220S/PVA_/S267K/S364K/E357Q
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLQEPDFYKTKIKLCILLHAFRIRAVTIDRVMSYLNAS*\GGGGSGGGGS\*EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* **(SEQ ID
NO:202)**

Figure 26Q

>XENP28852 human_IL12p40_(GGGGS)2-human_IL12p35(E163Q)_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD22914) - human_IL12p40_(GGGGS)2-Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVL SHSLLLLHKKEDGIWSTDILKDQKEPKNKTFLRCEAKNYSGRFTCWWLTTISTDLTFSVKSSRGSSDPQGVTCGA ATLSAERVRGDNKEYEYSVECQEDSACPAAEESLPIEVMVDAVHKLKYENYTSSFFIRDIIKPDPPKNLQLKPLK NSRQVEVSWEYPDTWSTPHSYFSLTFCVQVQGKSREKKDRVFTDKTSATVICRKNASISVRAQDRYYSSSWSEW ASVPCS\GGGGSGGGGS\EPKSSDKTHTCPPCPAPPVAGPSVFLFPPKPKDTLMISRTPEVTCVVVDVKHEDPEV KFNWYVDGVEVHNAKTKPREEEYNSTYRVVSVLTVLHQDWLNGKEYKCKVSNKALPAPIEKTISKAKGQPREPQV YTLPPSREEMTKNQVSLTCDVSGFYPSDIAVEWESDGQPENNYKTTPPVLDSDGSFFLYSKLTVDKSRWEQGDVF SCSVMHEALHNHYTQKSLSLSPGK* (SEQ ID NO:203)

Chain 2 (XenD24791) - human_IL12p35_E163Q_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL NSRETSFITNGSCLASRKTSFMMALCLSSIYEDLKMYQVEFKTMNAKLLMDPKRQIFLDQNMLAVIDELMQALNF NSETVPQKSSLEQPDFYKTKIKLCILLHAFRIRAVTIDRVMSYLNAS\GGGGSGGGGS\EPKSSDKTHTCPPCPA PPVAGPSVFLFPPKPKDTLMISRTPEVTCVVVDVKHEDPEVKFNWYVDGVEVHNAKTKPREEQYNSTYRVVSVLT VLHQDWLNGKEYKCKVSNKALPAPIEKTISKAKGQPREPQVYTLPPSREQMTKNQVKLTCLVKGFYPSDIAVEWE SNGQPENNYKTTPPVLDSDGSFFLYSKLTVDKSRWQQGNVFSCSVMHEALHNHYTQKSLSLSPGK* (SEQ ID NO:204)

Figure 29

| XENP | IL-12p40 Variant | IL-12p35 Variant | PSTAT4 EC50 | | FOLD DECREASE IN EC50 | |
|---|---|---|---|---|---|---|
| | | | CD4+ CD45RA+ CD25+ | CD8+ CD45RA+ CD25+ | CD4+ CD45RA+ CD25+ | CD8+ CD45RA+ CD25+ |
| 27201-1 | WT | WT | 0.003708 | 0.005468 | | |
| 27201-2 | WT | WT | 0.003182 | 0.004785 | | |
| 28821 | D87N | WT | 0.002181 | 0.004005 | 0.63 | 0.78 |
| 28822 | Q42E | WT | 0.005075 | 0.008822 | 1.47 | 1.72 |
| 28823 | E45Q | WT | 0.005 | 0.008541 | 1.45 | 1.67 |
| 28824 | Q56E | WT | 0.006622 | 0.01139 | 1.92 | 2.22 |
| 28825 | E59Q | WT | 0.01716 | 0.02519 | 4.98 | 4.91 |
| 28826 | D62N | WT | 0.005682 | 0.008183 | 1.65 | 1.60 |
| 28827 | Q42E/E45Q | WT | 0.003749 | 0.005398 | 1.09 | 1.05 |
| 28828 | E45Q/Q56E | WT | 0.004335 | 0.006014 | 1.26 | 1.17 |
| 28829 | Q42E/E59Q | WT | 0.01448 | 0.01896 | 4.20 | 3.70 |
| 28830 | Q56E/E59Q | WT | 0.01949 | 0.02855 | 5.66 | 5.57 |
| 28831 | Q42E/E45Q/Q56E | WT | 0.01266 | 0.02008 | 3.67 | 3.92 |
| 28832 | E45Q/Q56E/E59Q | WT | 0.02254 | 0.02873 | 6.54 | 5.60 |
| 28833 | D161N | WT | 0.006258 | 0.009723 | 1.82 | 1.90 |
| 28834 | E73Q | WT | 0.005763 | 0.009079 | 1.67 | 1.77 |
| 28835 | Q144E | WT | 0.00509 | 0.008766 | 1.48 | 1.71 |
| 28836 | E262Q | WT | 0.00241 | 0.004113 | 0.70 | 0.80 |
| 28837 | E100Q | WT | 0.004449 | 0.007287 | 1.29 | 1.42 |
| 28838 | D18N | WT | 0.003218 | 0.006053 | 0.93 | 1.18 |
| 28841 | E235Q | WT | 0.01259 | 0.01474 | 3.65 | 2.88 |
| 28842 | Q256E | WT | 0.006819 | 0.009489 | 1.98 | 1.85 |
| 28843 | E299Q | WT | 0.004098 | 0.007258 | 1.19 | 1.42 |
| 28844 | WT | E153Q | 0.009734 | 0.01212 | 2.83 | 2.36 |
| 28845 | WT | E38Q | 0.003759 | 0.005643 | 1.09 | 1.10 |
| 28846 | WT | N151D | 0.009653 | 0.01517 | 2.80 | 2.96 |
| 28847 | WT | Q135E | 0.00457 | 0.006908 | 1.33 | 1.35 |
| 28848 | WT | Q35D | 0.005247 | 0.00824 | 1.52 | 1.61 |
| 28849 | WT | Q146E | 0.004868 | 0.007417 | 1.41 | 1.45 |
| 28850 | WT | N76D | 0.004796 | 0.007424 | 1.39 | 1.45 |
| 28851 | WT | E162Q | 0.005616 | 0.008755 | 1.63 | 1.71 |
| 28852 | WT | E163Q | 0.004334 | 0.007082 | 1.26 | 1.38 |

Figure 30A

>IL12p40(E59K) (SEQ ID NO:205)
IWELKKDVYVVELDWYPDAPGEMVVLTCDTPEEDGITWTLDQSSEVLGSGKTLTIQVKKFGDAGQYTC
HKGGEVLSHSLLLLHKKEDGIWSTDILKDQKEPKNKTFLRCEAKNYSGRFTCWWLTTISTDLTFSVKS
SRGSSDPQGVTCGAATLSAERVRGDNKEYEYSVECQEDSACPAAEESLPIEVMVDAVHKLKYENYTSS
FFIRDIIKPDPPKNLQLKPLKNSRQVEVSWEYPDTWSTPHSYFSLTFCVQVQGKSKREKKDRVFTDKT
SATVICRKNASISVRAQDRYYSSSWSEWASVPCS

>IL12p40(E32Q/E59Q) (SEQ ID NO:206)
IWELKKDVYVVELDWYPDAPGEMVVLTCDTPQQEDGITWTLDQSSEVLGSGKTLTIQVKQFGDAGQYTC
HKGGEVLSHSLLLLHKKEDGIWSTDILKDQKEPKNKTFLRCEAKNYSGRFTCWWLTTISTDLTFSVKS
SRGSSDPQGVTCGAATLSAERVRGDNKEYEYSVECQEDSACPAAEESLPIEVMVDAVHKLKYENYTSS
FFIRDIIKPDPPKNLQLKPLKNSRQVEVSWEYPDTWSTPHSYFSLTFCVQVQGKSKREKKDRVFTDKT
SATVICRKNASISVRAQDRYYSSSWSEWASVPCS

>IL12p40(D34N/E59Q) (SEQ ID NO:207)
IWELKKDVYVVELDWYPDAPGEMVVLTCDTPEENGITWTLDQSSEVLGSGKTLTIQVKQFGDAGQYTC
HKGGEVLSHSLLLLHKKEDGIWSTDILKDQKEPKNKTFLRCEAKNYSGRFTCWWLTTISTDLTFSVKS
SRGSSDPQGVTCGAATLSAERVRGDNKEYEYSVECQEDSACPAAEESLPIEVMVDAVHKLKYENYTSS
FFIRDIIKPDPPKNLQLKPLKNSRQVEVSWEYPDTWSTPHSYFSLTFCVQVQGKSKREKKDRVFTDKT
SATVICRKNASISVRAQDRYYSSSWSEWASVPCS

>IL12p40(E59Q/E187Q) (SEQ ID NO:208)
IWELKKDVYVVELDWYPDAPGEMVVLTCDTPEEDGITWTLDQSSEVLGSGKTLTIQVKQFGDAGQYTC
HKGGEVLSHSLLLLHKKEDGIWSTDILKDQKEPKNKTFLRCEAKNYSGRFTCWWLTTISTDLTFSVKS
SRGSSDPQGVTCGAATLSAERVRGDNKEYEYSVECQEDSACPAAEESLPIQVMVDAVHKLKYENYTSS
FFIRDIIKPDPPKNLQLKPLKNSRQVEVSWEYPDTWSTPHSYFSLTFCVQVQGKSKREKKDRVFTDKT
SATVICRKNASISVRAQDRYYSSSWSEWASVPCS

>IL12p40(S43E/E59Q) (SEQ ID NO:209)
IWELKKDVYVVELDWYPDAPGEMVVLTCDTPEEDGITWTLDQESEVLGSGKTLTIQVKQFGDAGQYTC
HKGGEVLSHSLLLLHKKEDGIWSTDILKDQKEPKNKTFLRCEAKNYSGRFTCWWLTTISTDLTFSVKS
SRGSSDPQGVTCGAATLSAERVRGDNKEYEYSVECQEDSACPAAEESLPIEVMVDAVHKLKYENYTSS
FFIRDIIKPDPPKNLQLKPLKNSRQVEVSWEYPDTWSTPHSYFSLTFCVQVQGKSKREKKDRVFTDKT
SATVICRKNASISVRAQDRYYSSSWSEWASVPCS

Figure 30B

>IL12p40(S43K/E59Q) (SEQ ID NO:210)
IWELKKDVYVVELDWYPDAPGEMVVLTCDTPEEDGITWTLDQKSEVLGSGKTLTIQVKQFGDAGQYTC
HKGGEVLSHSLLLLHKKEDGIWSTDILKDQKEPKNKTFLRCEAKNYSGRFTCWWLTTISTDLTFSVKS
SRGSSDPQGVTCGAATLSAERVRGDNKEYEYSVECQEDSACPAAEESLPIEVMVDAVHKLKYENYTSS
FFIRDIIKPDPPKNLQLKPLKNSRQVEVSWEYPDTWSTPHSYFSLTFCVQVQGKSKREKKDRVFTDKT
SATVICRKNASISVRAQDRYYSSSWSEWASVPCS

>IL12p40(E59Q/K163E) (SEQ ID NO:211)
IWELKKDVYVVELDWYPDAPGEMVVLTCDTPEEDGITWTLDQSSEVLGSGKTLTIQVKQFGDAGQYTC
HKGGEVLSHSLLLLHKKEDGIWSTDILKDQKEPKNKTFLRCEAKNYSGRFTCWWLTTISTDLTFSVKS
SRGSSDPQGVTCGAATLSAERVRGDNEEYEYSVECQEDSACPAAEESLPIEVMVDAVHKLKYENYTSS
FFIRDIIKPDPPKNLQLKPLKNSRQVEVSWEYPDTWSTPHSYFSLTFCVQVQGKSKREKKDRVFTDKT
SATVICRKNASISVRAQDRYYSSSWSEWASVPCS

>IL12p40(E59Q/K99E) (SEQ ID NO:212)
IWELKKDVYVVELDWYPDAPGEMVVLTCDTPEEDGITWTLDQSSEVLGSGKTLTIQVKQFGDAGQYTC
HKGGEVLSHSLLLLHKKEDGIWSTDILKDQEEPKNKTFLRCEAKNYSGRFTCWWLTTISTDLTFSVKS
SRGSSDPQGVTCGAATLSAERVRGDNKEYEYSVECQEDSACPAAEESLPIEVMVDAVHKLKYENYTSS
FFIRDIIKPDPPKNLQLKPLKNSRQVEVSWEYPDTWSTPHSYFSLTFCVQVQGKSKREKKDRVFTDKT
SATVICRKNASISVRAQDRYYSSSWSEWASVPCS

>IL12p40(E59Q/K258E) (SEQ ID NO:213)
IWELKKDVYVVELDWYPDAPGEMVVLTCDTPEEDGITWTLDQSSEVLGSGKTLTIQVKQFGDAGQYTC
HKGGEVLSHSLLLLHKKEDGIWSTDILKDQKEPKNKTFLRCEAKNYSGRFTCWWLTTISTDLTFSVKS
SRGSSDPQGVTCGAATLSAERVRGDNKEYEYSVECQEDSACPAAEESLPIEVMVDAVHKLKYENYTSS
FFIRDIIKPDPPKNLQLKPLKNSRQVEVSWEYPDTWSTPHSYFSLTFCVQVQGESKREKKDRVFTDKT
SATVICRKNASISVRAQDRYYSSSWSEWASVPCS

>IL12p40(E59Q/K260E) (SEQ ID NO:214)
IWELKKDVYVVELDWYPDAPGEMVVLTCDTPEEDGITWTLDQSSEVLGSGKTLTIQVKQFGDAGQYTC
HKGGEVLSHSLLLLHKKEDGIWSTDILKDQKEPKNKTFLRCEAKNYSGRFTCWWLTTISTDLTFSVKS
SRGSSDPQGVTCGAATLSAERVRGDNKEYEYSVECQEDSACPAAEESLPIEVMVDAVHKLKYENYTSS
FFIRDIIKPDPPKNLQLKPLKNSRQVEVSWEYPDTWSTPHSYFSLTFCVQVQGKSEREKKDRVFTDKT
SATVICRKNASISVRAQDRYYSSSWSEWASVPCS

Figure 31A

\>XenD25922_human_IL12p40_E59K_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPEEDGITWTLDQSSEVLGSGKTLTIQVKKFGDAGQYTC
HKGGEVLSHSLLLLHKKEDGIWSTDILKDQKEPKNKTFLRCEAKNYSGRFTCWWLTTISTDLTFSVKS
SRGSSDPQGVTCGAATLSAERVRGDNKEYEYSVECQEDSACPAAEESLPIEVMVDAVHKLKYENYTSS
FFIRDIIKPDPPKNLQLKPLKNSRQVEVSWEYPDTWSTPHSYFSLTFCVQVQGKSKREKKDRVFTDKT
SATVICRKNASISVRAQDRYYSSSWSEWASVPCS\GGGGSGGGGS\EPKSSDKTHTCPPCPAPPVAGP
SVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLS
LSPGK* (SEQ ID NO:215)

\>XenD25923_human_IL12p40_E32Q/E59Q_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPQEDGITWTLDQSSEVLGSGKTLTIQVKQFGDAGQYTC
HKGGEVLSHSLLLLHKKEDGIWSTDILKDQKEPKNKTFLRCEAKNYSGRFTCWWLTTISTDLTFSVKS
SRGSSDPQGVTCGAATLSAERVRGDNKEYEYSVECQEDSACPAAEESLPIEVMVDAVHKLKYENYTSS
FFIRDIIKPDPPKNLQLKPLKNSRQVEVSWEYPDTWSTPHSYFSLTFCVQVQGKSKREKKDRVFTDKT
SATVICRKNASISVRAQDRYYSSSWSEWASVPCS\GGGGSGGGGS\EPKSSDKTHTCPPCPAPPVAGP
SVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLS
LSPGK* (SEQ ID NO:216)

\>XenD25924_human_IL12p40_D34N/E59Q_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPEENGITWTLDQSSEVLGSGKTLTIQVKQFGDAGQYTC
HKGGEVLSHSLLLLHKKEDGIWSTDILKDQKEPKNKTFLRCEAKNYSGRFTCWWLTTISTDLTFSVKS
SRGSSDPQGVTCGAATLSAERVRGDNKEYEYSVECQEDSACPAAEESLPIEVMVDAVHKLKYENYTSS
FFIRDIIKPDPPKNLQLKPLKNSRQVEVSWEYPDTWSTPHSYFSLTFCVQVQGKSKREKKDRVFTDKT
SATVICRKNASISVRAQDRYYSSSWSEWASVPCS\GGGGSGGGGS\EPKSSDKTHTCPPCPAPPVAGP
SVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLS
LSPGK* (SEQ ID NO:217)

\>XenD25925_human_IL12p40_E59Q/E187Q_(GGGGS)2-Fc(216)_IgG1_pI(-
)_Isosteric_A_C220S/PVA_/S267K/L368D/K370S_pTT5

*IWELKKDVYVVELDWYPDAPGEMVVLTCDTPEEDGITWTLDQSSEVLGSGKTLTIQVKQFGDAGQYTC
HKGGEVLSHSLLLLHKKEDGIWSTDILKDQKEPKNKTFLRCEAKNYSGRFTCWWLTTISTDLTFSVKS
SRGSSDPQGVTCGAATLSAERVRGDNKEYEYSVECQEDSACPAAEESLPIQVMVDAVHKLKYENYTSS
FFIRDIIKPDPPKNLQLKPLKNSRQVEVSWEYPDTWSTPHSYFSLTFCVQVQGKSKREKKDRVFTDKT
SATVICRKNASISVRAQDRYYSSSWSEWASVPCS\GGGGSGGGGS\EPKSSDKTHTCPPCPAPPVAGP
SVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLS
LSPGK* (SEQ ID NO:218)

Figure 31B

>XenD25926 human_IL12p40_S43E/E59Q_(GGGGS)2-Fc(216)_IgG1_pI(-)_Isosteric_A_C220S/PVA_/S267K/L368D/K370S_pTT5

*IWELKKDVYVVELDWYPDAPGEMVVLTCDTPEEDGITWTLDQESEVLGSGKTLTIQVKQFGDAGQYTC*
*HKGGEVLSHSLLLLHKKEDGIWSTDILKDQKEPKNKTFLRCEAKNYSGRFTCWWLTTISTDLTFSVKS*
*SRGSSDPQGVTCGAATLSAERVRGDNKEYEYSVECQEDSACPAAEESLPIEVMVDAVHKLKYENYTSS*
*FFIRDIIKPDPPKNLQLKPLKNSRQVEVSWEYPDTWSTPHSYFSLTFCVQVQGKSKREKKDRVFTDKT*
*SATVICRKNASISVRAQDRYYSSSWSEWASVPCS\GGGGSGGGGS\EPKSSDKTHTCPPCPAPPVAGP*
*SVFLFPPKPKDTLMISRTPEVTCVVVDVKHEDPEVKFNWYVDGVEVHNAKTKPREEEYNSTYRVVSVL*
*TVLHQDWLNGKEYKCKVSNKALPAPIEKTISKAKGQPREPQVYTLPPSREEMTKNQVSLTCDVSGFYP*
*SDIAVEWESDGQPENNYKTTPPVLDSDGSFFLYSKLTVDKSRWEQGDVFSCSVMHEALHNHYTQKSLS*
*LSPGK* (SEQ ID NO:219)

>XenD25927 human_IL12p40_S43K/E59Q_(GGGGS)2-Fc(216)_IgG1_pI(-)_Isosteric_A_C220S/PVA_/S267K/L368D/K370S_pTT5

*IWELKKDVYVVELDWYPDAPGEMVVLTCDTPEEDGITWTLDQKSEVLGSGKTLTIQVKQFGDAGQYTC*
*HKGGEVLSHSLLLLHKKEDGIWSTDILKDQKEPKNKTFLRCEAKNYSGRFTCWWLTTISTDLTFSVKS*
*SRGSSDPQGVTCGAATLSAERVRGDNKEYEYSVECQEDSACPAAEESLPIEVMVDAVHKLKYENYTSS*
*FFIRDIIKPDPPKNLQLKPLKNSRQVEVSWEYPDTWSTPHSYFSLTFCVQVQGKSKREKKDRVFTDKT*
*SATVICRKNASISVRAQDRYYSSSWSEWASVPCS\GGGGSGGGGS\EPKSSDKTHTCPPCPAPPVAGP*
*SVFLFPPKPKDTLMISRTPEVTCVVVDVKHEDPEVKFNWYVDGVEVHNAKTKPREEEYNSTYRVVSVL*
*TVLHQDWLNGKEYKCKVSNKALPAPIEKTISKAKGQPREPQVYTLPPSREEMTKNQVSLTCDVSGFYP*
*SDIAVEWESDGQPENNYKTTPPVLDSDGSFFLYSKLTVDKSRWEQGDVFSCSVMHEALHNHYTQKSLS*
*LSPGK* (SEQ ID NO:220)

>XenD25928 human_IL12p40_E59Q/K163E_(GGGGS)2-Fc(216)_IgG1_pI(-)_Isosteric_A_C220S/PVA_/S267K/L368D/K370S_pTT5

*IWELKKDVYVVELDWYPDAPGEMVVLTCDTPEEDGITWTLDQSSEVLGSGKTLTIQVKQFGDAGQYTC*
*HKGGEVLSHSLLLLHKKEDGIWSTDILKDQKEPKNKTFLRCEAKNYSGRFTCWWLTTISTDLTFSVKS*
*SRGSSDPQGVTCGAATLSAERVRGDNEEYEYSVECQEDSACPAAEESLPIEVMVDAVHKLKYENYTSS*
*FFIRDIIKPDPPKNLQLKPLKNSRQVEVSWEYPDTWSTPHSYFSLTFCVQVQGKSKREKKDRVFTDKT*
*SATVICRKNASISVRAQDRYYSSSWSEWASVPCS\GGGGSGGGGS\EPKSSDKTHTCPPCPAPPVAGP*
*SVFLFPPKPKDTLMISRTPEVTCVVVDVKHEDPEVKFNWYVDGVEVHNAKTKPREEEYNSTYRVVSVL*
*TVLHQDWLNGKEYKCKVSNKALPAPIEKTISKAKGQPREPQVYTLPPSREEMTKNQVSLTCDVSGFYP*
*SDIAVEWESDGQPENNYKTTPPVLDSDGSFFLYSKLTVDKSRWEQGDVFSCSVMHEALHNHYTQKSLS*
*LSPGK* (SEQ ID NO:221)

>XenD25929 human_IL12p40_E59Q/K99E_(GGGGS)2-Fc(216)_IgG1_pI(-)_Isosteric_A_C220S/PVA_/S267K/L368D/K370S_pTT5

*IWELKKDVYVVELDWYPDAPGEMVVLTCDTPEEDGITWTLDQSSEVLGSGKTLTIQVKQFGDAGQYTC*
*HKGGEVLSHSLLLLHKKEDGIWSTDILKDQEEPKNKTFLRCEAKNYSGRFTCWWLTTISTDLTFSVKS*
*SRGSSDPQGVTCGAATLSAERVRGDNKEYEYSVECQEDSACPAAEESLPIEVMVDAVHKLKYENYTSS*
*FFIRDIIKPDPPKNLQLKPLKNSRQVEVSWEYPDTWSTPHSYFSLTFCVQVQGKSKREKKDRVFTDKT*
*SATVICRKNASISVRAQDRYYSSSWSEWASVPCS\GGGGSGGGGS\EPKSSDKTHTCPPCPAPPVAGP*
*SVFLFPPKPKDTLMISRTPEVTCVVVDVKHEDPEVKFNWYVDGVEVHNAKTKPREEEYNSTYRVVSVL*
*TVLHQDWLNGKEYKCKVSNKALPAPIEKTISKAKGQPREPQVYTLPPSREEMTKNQVSLTCDVSGFYP*
*SDIAVEWESDGQPENNYKTTPPVLDSDGSFFLYSKLTVDKSRWEQGDVFSCSVMHEALHNHYTQKSLS*
*LSPGK* (SEQ ID NO:222)

Figure 31C

>XenD25930 human_IL12p40_E59Q/K258E_(GGGGS)2-Fc(216)_IgG1_pI(-
)_Isosteric_A_C220S/PVA_/S267K/L368D/K370S_pTT5
*IWELKKDVYVVELDWYPDAPGEMVVLTCDTPEEDGITWTLDQSSEVLGSGKTLTIQVKQFGDAGQYTC
HKGGEVLSHSLLLLHKKEDGIWSTDILKDQKEPKNKTFLRCEAKNYSGRFTCWWLTTISTDLTFSVKS
SRGSSDPQGVTCGAATLSAERVRGDNKEYEYSVECQEDSACPAAEESLPIEVMVDAVHKLKYENYTSS
FFIRDIIKPDPPKNLQLKPLKNSRQVEVSWEYPDTWSTPHSYFSLTFCVQVQGESKREKKDRVFTDKT
SATVICRKNASISVRAQDRYYSSSWSEWASVPCS\GGGGSGGGGS\EPKSSDKTHTCPPCPAPPVAGP
SVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLS
LSPGK* (SEQ ID NO:223)

>XenD25931 human_IL12p40_E59Q/K260E_(GGGGS)2-Fc(216)_IgG1_pI(-
)_Isosteric_A_C220S/PVA_/S267K/L368D/K370S_pTT5
*IWELKKDVYVVELDWYPDAPGEMVVLTCDTPEEDGITWTLDQSSEVLGSGKTLTIQVKQFGDAGQYTC
HKGGEVLSHSLLLLHKKEDGIWSTDILKDQKEPKNKTFLRCEAKNYSGRFTCWWLTTISTDLTFSVKS
SRGSSDPQGVTCGAATLSAERVRGDNKEYEYSVECQEDSACPAAEESLPIEVMVDAVHKLKYENYTSS
FFIRDIIKPDPPKNLQLKPLKNSRQVEVSWEYPDTWSTPHSYFSLTFCVQVQGKSEREKKDRVFTDKT
SATVICRKNASISVRAQDRYYSSSWSEWASVPCS\GGGGSGGGGS\EPKSSDKTHTCPPCPAPPVAGP
SVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYP
SDIAVEWESDGQPENNYKTTPPVLDSDGSFFLYSKLTVDKSRWEQGDVFSCSVMHEALHNHYTQKSLS
LSPGK* (SEQ ID NO:224)

Figure 32

>IL12p35(N151D/E153Q) (SEQ ID NO:225)
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
DSQ**TVPQKSSLEEPDFYKTKIKLCILLHAFRIRAVTIDRVMSYLNAS

>IL12p35(E153K) (SEQ ID NO:226)
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSKTVPQKSSLEEPDFYKTKIKLCILLHAFRIRAVTIDRVMSYLNAS

>IL12p35(N151K) (SEQ ID NO:227)
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
KSETVPQKSSLEEPDFYKTKIKLCILLHAFRIRAVTIDRVMSYLNAS

>IL12p35(N151D/D165N) (SEQ ID NO:228)
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
DSETVPQKSSLEEPNFYKTKIKLCILLHAFRIRAVTIDRVMSYLNAS

>IL12p35(Q130E/N151D) (SEQ ID NO:229)
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKREIFLDQNMLAVIDELMQALNF
DSETVPQKSSLEEPDFYKTKIKLCILLHAFRIRAVTIDRVMSYLNAS

>IL12p35(N151D/K158E) (SEQ ID NO:230)
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
DSETVPQESSLEEPDFYKTKIKLCILLHAFRIRAVTIDRVMSYLNAS

>IL12p35(E79Q/N151D) (SEQ ID NO:231)
RNLPVATPDPGMFPCLHHSQNLLRAVSNMLQKARQTLEFYPCTSEEIDHEDITKDKTSTVEACLPLELTKNESCL
NSRQTSFITNGSCLASRKTSFMMALCLSSIYEDLKMYQVEFKTMNAKLLMDPKRQIFLDQNMLAVIDELMQALNF
DSETVPQKSSLEEPDFYKTKIKLCILLHAFRIRAVTIDRVMSYLNAS

>IL12p35(D55Q/N151D) (SEQ ID NO:232)
RNLPVATPDPGMFPCLHHSQNLLRAVSNMLQKARQTLEFYPCTSEEIDHEDITKQKTSTVEACLPLELTKNESCL
NSRETSFITNGSCLASRKTSFMMALCLSSIYEDLKMYQVEFKTMNAKLLMDPKRQIFLDQNMLAVIDELMQALNF
DSETVPQKSSLEEPDFYKTKIKLCILLHAFRIRAVTIDRVMSYLNAS

>IL12p35(N136D/N151D) (SEQ ID NO:233)
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQDMLAVIDELMQALNF
DSETVPQKSSLEEPDFYKTKIKLCILLHAFRIRAVTIDRVMSYLNAS

>IL12p35(N21D/N151D) (SEQ ID NO:234)
RNLPVATPDPGMFPCLHHSQDLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
DSETVPQKSSLEEPDFYKTKIKLCILLHAFRIRAVTIDRVMSYLNAS

>IL12p35(E143Q/N151D) (SEQ ID NO:235)
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDQLMQALNF
DSETVPQKSSLEEPDFYKTKIKLCILLHAFRIRAVTIDRVMSYLNAS

Figure 33A

>XenD25911
human_IL12p35_N151D/E153Q_(GGGGS)2_Fc(216)_IgG1_C220S/PVA_/S267K/S364K/E357Q_pTT5
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
DSQTVPQKSSLEEPDFYKTKIKLCILLHAFRIRAVTIDRVMSYLNAS*\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:236)

>XenD25912 human_IL12p35_E153K_(GGGGS)2_Fc(216)_IgG1_C220S/PVA_/S267K/S364K/E357Q_pTT5
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSKTVPQKSSLEEPDFYKTKIKLCILLHAFRIRAVTIDRVMSYLNAS*\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:237)

>XenD25913 human_IL12p35_N151K_(GGGGS)2_Fc(216)_IgG1_C220S/PVA_/S267K/S364K/E357Q_pTT5
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
KSETVPQKSSLEEPDFYKTKIKLCILLHAFRIRAVTIDRVMSYLNAS*\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:238)

>XenD25914
human_IL12p35_N151D/D165N_(GGGGS)2_Fc(216)_IgG1_C220S/PVA_/S267K/S364K/E357Q_pTT5
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
DSETVPQKSSLEEPNFYKTKIKLCILLHAFRIRAVTIDRVMSYLNAS*\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:239)

>XenD25915
human_IL12p35_Q130E/N151D_(GGGGS)2_Fc(216)_IgG1_C220S/PVA_/S267K/S364K/E357Q_pTT5
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKREIFLDQNMLAVIDELMQALNF
DSETVPQKSSLEEPDFYKTKIKLCILLHAFRIRAVTIDRVMSYLNAS*\GGGGSGGGGS\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:240)

>XenD25916 human_IL12p35_N151D/K158E_(GGGGS)2_Fc(216)_IgG1_C220S/PVA_/S267K/S364K/E357Q_pTT5
*RNLPVATPDPGMFPCLHHSQNLLRAVSNMLQKARQTLEFYPCTSEEIDHEDITKDKTSTVEACLPLELTKNESCLNSRE
TSFITNGSCLASRKTSFMMALCLSSIYEDLKMYQVEFKTMNAKLLMDPKRQIFLDQNMLAVIDELMQALNFDSETVPQE
SSLEEPDFYKTKIKLCILLHAFRIRAVTIDRVMSYLNAS*\GGGGSGGGGS\EPKSSDKTHTCPPCPAPPVAGPSVFLFP
PKPKDTLMISRTPEVTCVVVDVKHEDPEVKFNWYVDGVEVHNAKTKPREEQYNSTYRVVSVLTVLHQDWLNGKEYKCKV
SNKALPAPIEKTISKAKGQPREPQVYTLPPSREQMTKNQVKLTCLVKGFYPSDIAVEWESNGQPENNYKTTPPVLDSDG
SFFLYSKLTVDKSRWQQGNVFSCSVMHEALHNHYTQKSLSLSPGK (SEQ ID NO:241)

Figure 33B

>XenD25917
human_IL12p35_E79Q/N151D_(GGGGS)2_Fc(216)_IgG1_C220S/PVA_/S267K/S364K/E357Q_pTT5
*RNLPVATPDPGMFPCLHHSQNLLRAVSNMLQKARQTLEFYPCTSEEIDHEDITKDKTSTVEACLPLELTKNESCL
NSRQTSFITNGSCLASRKTSFMMALCLSSIYEDLKMYQVEFKTMNAKLLMDPKRQIFLDQNMLAVIDELMQALNF
DSETVPQKSSLEEPDFYKTKIKLCILLHAFRIRAVTIDRVMSYLNAS\<u>GGGGSGGGGS</u>\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* <u>(SEQ ID NO:242)</u>

>XenD25918
human_IL12p35_D55Q/N151D_(GGGGS)2_Fc(216)_IgG1_C220S/PVA_/S267K/S364K/E357Q_pTT5
*RNLPVATPDPGMFPCLHHSQNLLRAVSNMLQKARQTLEFYPCTSEEIDHEDITKQKTSTVEACLPLELTKNESCL
NSRETSFITNGSCLASRKTSFMMALCLSSIYEDLKMYQVEFKTMNAKLLMDPKRQIFLDQNMLAVIDELMQALNF
DSETVPQKSSLEEPDFYKTKIKLCILLHAFRIRAVTIDRVMSYLNAS\<u>GGGGSGGGGS</u>\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* <u>(SEQ ID NO:243)</u>

>XenD25919
human_IL12p35_N136D/N151D_(GGGGS)2_Fc(216)_IgG1_C220S/PVA_/S267K/S364K/E357Q_pTT5
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQDMLAVIDELMQALNF
DSETVPQKSSLEEPDFYKTKIKLCILLHAFRIRAVTIDRVMSYLNAS\<u>GGGGSGGGGS</u>\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* <u>(SEQ ID NO:244)</u>

>XenD25920
human_IL12p35_N21D/N151D_(GGGGS)2_Fc(216)_IgG1_C220S/PVA_/S267K/S364K/E357Q_pTT5
*RNLPVATPDPGMFPCLHHSQDLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
DSETVPQKSSLEEPDFYKTKIKLCILLHAFRIRAVTIDRVMSYLNAS\<u>GGGGSGGGGS</u>\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* <u>(SEQ ID NO:245)</u>

>XenD25921
human_IL12p35_E143Q/N151D_(GGGGS)2_Fc(216)_IgG1_C220S/PVA_/S267K/S364K/E357Q_pTT5
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDQLMQALNF
DSETVPQKSSLEEPDFYKTKIKLCILLHAFRIRAVTIDRVMSYLNAS\<u>GGGGSGGGGS</u>\EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* <u>(SEQ ID NO:246)</u>

Figure 34A

>XENP29949 human_IL12p40{E59Q}_(GGGGS)2-human_IL12p35{N151D}_(GGGGS)2-Fc(216)_IgG1_pI{-}_Isosteric_A_C220S/PVA_/S267K/L368D/K370S_Fc(216)_IgG1_C220S/PVA_/S267K/S364K/E357Q Chain 1 (XenD24760) - human_IL12p40{E59Q}_(GGGGS)2_Fc(216)_IgG1_pI{-}_Isosteric_A_C220S/PVA_/S267K/L368D/K370S IWELKKDVYVVELDWYPDAPGEMVVLTCDTPEEDGITWTLDQSSEVLGSGKTLTIQVKQFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK (SEQ ID NO:93)

Chain 2 (XenD24785) - human_IL12p35{N151D}_(GGGGS)2_Fc(216)_IgG1_C220S/PVA_/S267K/S364K/E357Q RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
DSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK (SEQ ID
NO:132)

>XENP29950 human_IL12p40{Q56E/E59Q}_(GGGGS)2-human_IL12p35{N151D}_(GGGGS)2-Fc(216)_IgG1_pI{-}_Isosteric_A_C220S/PVA_/S267K/L368D/K370S_Fc(216)_IgG1_C220S/PVA_/S267K/S364K/E357Q Chain 1 (XenD24765) - human_IL12p40{Q56E/E59Q}_(GGGGS)2_Fc(216)_IgG1_pI{-}_Isosteric_A_C220S/PVA_/S267K/L368D/K370S IWELKKDVYVVELDWYPDAPGEMVVLTCDTPEEDGITWTLDQSSEVLGSGKTLTIEVKQFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK (SEQ ID NO:98)

Chain 2 (XenD24785) - human_IL12p35{N151D}_(GGGGS)2_Fc(216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
DSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK (SEQ ID
NO:132)

Figure 34B

>XENP29951 human_IL12p40(E59K)_(GGGGS)2-human_IL12p35(N151D)_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD25922) - human_IL12p40(E59K)_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:215)

Chain 2 (XenD24785) - human_IL12p35(N151D)_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
DSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:132)

>XENP29952 human_IL12p40(E59K)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD25922) - human_IL12p40(E59K)_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:215)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:433)

Figure 34C

>XENP29953 human_IL12p40(E32Q/E59Q)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

Chain 1 (XenD25923) - human_IL12p40(E32Q/E59Q)_(GGGGS)2_Fc(216)_IgG1_pI(-)_Isosteric_A_C220S/PVA_/S267K/L368D/K370S

*IWELKKDVYVVELDWYPDAPGEMVVLTCDTPQEDGITWTLDQSSEVLGSGKTLTIQVKQFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/*GGGGSGGGGS*/EPKSSDKTHTCPPCPAPPVAGPSVFLPPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:216)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/*GGGGSGGGGS*/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:434)

>XENP29954 human_IL12p40(D34N/E59Q)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

Chain 1 (XenD25924) - human_IL12p40(D34N/E59Q)_(GGGGS)2_Fc(216)_IgG1_pI(-)_Isosteric_A_C220S/PVA_/S267K/L368D/K370S

*IWELKKDVYVVELDWYPDAPGEMVVLTCDTPEENGITWTLDQSSEVLGSGKTLTIQVKQFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/*GGGGSGGGGS*/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:217)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/*GGGGSGGGGS*/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:435)

Figure 34D

>XENP29955 human_IL12p40(E59Q/E187Q)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S364K/E357Q

Chain 1 (XenD25925) - human_IL12p40(E59Q/E187Q)_(GGGGS)2_Fc(216)_IgG1_pI(-)_Isosteric_A_C220S/PVA_/S267K/L368D/K370S IWELKKDVYVVELDWYPDAPGEMVVLTCDTPEEDGITWTLDQSSEVLGSGKTLTIQVKQFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIQVMDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK     (SEQ ID NO:218)

Chain 2 (XenD22915) - human_IL12p35_(GGGGS)2_Fc(216)_IgG1_C220S/PVA_/S364K/E357Q RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK     (SEQ ID NO:436)

>XENP29956 human_IL12p40(S43E/E59Q)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S364K/E357Q

Chain 1 (XenD25926) - human_IL12p40(S43E/E59Q)_(GGGGS)2_Fc(216)_IgG1_pI(-)_Isosteric_A_C220S/PVA_/S267K/L368D/K370S IWELKKDVYVVELDWYPDAPGEMVVLTCDTPEEDGITWTLDQESEVLGSGKTLTIQVKQFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK     (SEQ ID NO:219)

Chain 2 (XenD22915) - human_IL12p35_(GGGGS)2_Fc(216)_IgG1_C220S/PVA_/S364K/E357Q
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK     (SEQ ID NO:437)

Figure 34E

>XENP29957 human_IL12p40(S43K/E59Q)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD25927) - human_IL12p40(S43K/E59Q)_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQKSEVLGSGKTLTIQVKQFGDAGQYTCHKGGEVL*
*SHSLLLLHKKEDGIWSTDILKDQKEPKNKTFLRCEAKNYSGRFTCWWLTTISTDLTFSVKSSRGSSDPQGVTCGA*
*ATLSAERVRGDNKEYEYSVECQEDSACPAAEESLPIEVMVDAVHKLKYENYTSSFFIRDIIKPDPPKNLQLKPLK*
*NSRQVEVSWEYPDTWSTPHSYFSLTFCVQVQGKSKREKKDRVFTDKTSATVICRKNASISVRAQDRYYSSSWSEW*
*ASVPCS*/GGGGSGGGGS/*EPKSSDKTHTCPPCPAPPVAGPSVFLFPPKPKDTLMISRTPEVTCVVVDVKHEDPEV*
*KFNWYVDGVEVHNAKTKPREEEYNSTYRVVSVLTVLHQDWLNGKEYKCKVSNKALPAPIEKTISKAKGQPREPQV*
*YTLPPSREEMTKNQVSLTCDVSGFYPSDIAVEWESDGQPENNYKTTPPVLDSDGSFFLYSKLTVDKSRWEQGDVF*
*SCSVMHEALHNHYTQKSLSLSPGK* (SEQ ID NO:220)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL*
*NSRETSFITNGSCLASRKTSFMMALCLSSIYEDLKMYQVEFKTMNAKLLMDPKRQIFLDQNMLAVIDELMQALNF*
*NSETVPQKSSLEEPDFYKTKIKLCILLHAFRIRAVTIDRVMSYLNAS*/GGGGSGGGGS/*EPKSSDKTHTCPPCPA*
*PPVAGPSVFLFPPKPKDTLMISRTPEVTCVVVDVKHEDPEVKFNWYVDGVEVHNAKTKPREEQYNSTYRVVSVLT*
*VLHQDWLNGKEYKCKVSNKALPAPIEKTISKAKGQPREPQVYTLPPSREQMTKNQVKLTCLVKGFYPSDIAVEWE*
*SNGQPENNYKTTPPVLDSDGSFFLYSKLTVDKSRWQQGNVFSCSVMHEALHNHYTQKSLSLSPGK* (SEQ ID NO:438)

>XENP29958 human_IL12p40(E59Q/K163E)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD25928) - human_IL12p40(E59Q/K163E)_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKQFGDAGQYTCHKGGEVL*
*SHSLLLLHKKEDGIWSTDILKDQKEPKNKTFLRCEAKNYSGRFTCWWLTTISTDLTFSVKSSRGSSDPQGVTCGA*
*ATLSAERVRGDNEEYEYSVECQEDSACPAAEESLPIEVMVDAVHKLKYENYTSSFFIRDIIKPDPPKNLQLKPLK*
*NSRQVEVSWEYPDTWSTPHSYFSLTFCVQVQGKSKREKKDRVFTDKTSATVICRKNASISVRAQDRYYSSSWSEW*
*ASVPCS*/GGGGSGGGGS/*EPKSSDKTHTCPPCPAPPVAGPSVFLFPPKPKDTLMISRTPEVTCVVVDVKHEDPEV*
*KFNWYVDGVEVHNAKTKPREEEYNSTYRVVSVLTVLHQDWLNGKEYKCKVSNKALPAPIEKTISKAKGQPREPQV*
*YTLPPSREEMTKNQVSLTCDVSGFYPSDIAVEWESDGQPENNYKTTPPVLDSDGSFFLYSKLTVDKSRWEQGDVF*
*SCSVMHEALHNHYTQKSLSLSPGK* (SEQ ID NO:221)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL*
*NSRETSFITNGSCLASRKTSFMMALCLSSIYEDLKMYQVEFKTMNAKLLMDPKRQIFLDQNMLAVIDELMQALNF*
*NSETVPQKSSLEEPDFYKTKIKLCILLHAFRIRAVTIDRVMSYLNAS*/GGGGSGGGGS/*EPKSSDKTHTCPPCPA*
*PPVAGPSVFLFPPKPKDTLMISRTPEVTCVVVDVKHEDPEVKFNWYVDGVEVHNAKTKPREEQYNSTYRVVSVLT*
*VLHQDWLNGKEYKCKVSNKALPAPIEKTISKAKGQPREPQVYTLPPSREQMTKNQVKLTCLVKGFYPSDIAVEWE*
*SNGQPENNYKTTPPVLDSDGSFFLYSKLTVDKSRWQQGNVFSCSVMHEALHNHYTQKSLSLSPGK* (SEQ ID NO:439)

Figure 34F

>XENP29959_human_IL12p40(E59Q/K99E)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD25929) - human_IL12p40(E59Q/K99E)_(GGGGS)2_Fc(216)_IgG1_pI(-)_Isosteric_A_C220S/PVA_/S267K/L368D/K370S IWELKKDVYVVELDWYPDAPGEMVVLTCDTPEEDGITWTLDQSSEVLGSGKTLTIQVKQFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK    (SEQ ID NO:222)

Chain 2 (XenD22915) - human_IL12p35_(GGGGS)2_Fc(216)_IgG1_C220S/PVA_/S267K/S364K/E357Q RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK    (SEQ ID
NO:440)

>XENP29960_human_IL12p40(E59Q/K258E)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD25930) - human_IL12p40(E59Q/K258E)_(GGGGS)2_Fc(216)_IgG1_pI(-)_Isosteric_A_C220S/PVA_/S267K/L368D/K370S IWELKKDVYVVELDWYPDAPGEMVVLTCDTPEEDGITWTLDQSSEVLGSGKTLTIQVKQFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGESKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK    (SEQ ID NO:223)

Chain 2 (XenD22915) - human_IL12p35_(GGGGS)2_Fc(216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK    (SEQ ID
NO:441)

Figure 34G

>XENP29961 human_IL12p40(E59Q/K260E)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

Chain 1 (XenD25931) - human_IL12p40(E59Q/K260E)_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKQFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSEREKKDRVFTDKTSATVICRKNASISVRAQDRYYSSSWSEW
ASVPCS/<u>GGGGSGGGGS</u>/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:224)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/<u>GGGGSGGGGS</u>/EPKSSDKTHTCPPCPA
PPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:442)

>XENP29962 human_IL12p40_(GGGGS)2-human_IL12p35(N151D/E153Q)_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q

Chain 1 (XenD22914) - human_IL12p40_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/<u>GGGGSGGGGS</u>/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:47)

Chain 2 (XenD25911) - human_IL12p35(N151D/E153Q)_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
DSQTVPQKSSLEEPDFYKTKIKLCILLHAFRIRAVTIDRVMSYLNAS/<u>GGGGSGGGGS</u>/EPKSSDKTHTCPPCPA
PPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:236)

Figure 34H

>XENP29963 human_IL12p40_(GGGGS)2-human_IL12p35(E153K)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD22914) - human_IL12p40_(GGGGS)2_Fc(216)_IgG1_pI(-
)_Isosteric_A_C220S/PVA_/S267K/L368D/K370S
*IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/<u>GGGGSGGGGS</u>/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:47)

Chain 2 (XenD25912) - human_IL12p35(E153K)_(GGGGS)2_Fc(216)_IgG1_C220S/PVA_/S267K/S364K/E357Q
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSKTVPQKSSLEEPDFYKTKIKLCILLHAFRIRAVTIDRVMSYLNAS/<u>GGGGSGGGGS</u>/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID
NO:237)

>XENP29964 human_IL12p40_(GGGGS)2-human_IL12p35(N151K)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD22914) - human_IL12p40_(GGGGS)2_Fc(216)_IgG1_pI(-
)_Isosteric_A_C220S/PVA_/S267K/L368D/K370S
*IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/<u>GGGGSGGGGS</u>/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:47)

Chain 2 (XenD25913) - human_IL12p35(N151K)_(GGGGS)2_Fc(216)_IgG1_C220S/PVA_/S267K/S364K/E357Q
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
KSETVPQKSSLEEPDFYKTKIKLCILLHAFRIRAVTIDRVMSYLNAS/<u>GGGGSGGGGS</u>/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID
NO:238)

Figure 34I

>XENP29965 human_IL12p40_(GGGGS)2-human_IL12p35(N151D/D165N)_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD22914) - human_IL12p40_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS*/<u>GGGGSGGGGS</u>/*EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:47)

Chain 2 (XenD25914) - human_IL12p35(N151D/D165N)_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
DSETVPQKSSLEEPNFYKTKIKLCILLHAFRIRAVTIDRVMSYLNAS*/<u>GGGGSGGGGS</u>/*EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:239)

>XENP29966 human_IL12p40_(GGGGS)2-human_IL12p35(Q130E/N151D)_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD22914) - human_IL12p40_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS*/<u>GGGGSGGGGS</u>/*EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:47)

Chain 2 (XenD25915) - human_IL12p35(Q130E/N151D)_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKREIFLDQNMLAVIDELMQALNF
DSETVPQKSSLEEPDFYKTKIKLCILLHAFRIRAVTIDRVMSYLNAS*/<u>GGGGSGGGGS</u>/*EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:240)

Figure 34J

>XENP29967 human_IL12p40_(GGGGS)2-human_IL12p35(N151D/K158E)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q

**Chain 1 (XenD22914) - human_IL12p40_(GGGGS)2_Fc(216)_IgG1_pI(-
)_Isosteric_A_C220S/PVA_/S267K/L368D/K370S**

*IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/*GGGGSGGGGS*/EPKSSDKTHTCPPCPAPPVAGPSVFLPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK*     (SEQ ID NO:47)

**Chain 2 (XenD25916) -
human_IL12p35(N151D/K158E)_(GGGGS)2_Fc(216)_IgG1_C220S/PVA_/S267K/S364K/E357Q**

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
DSETVPQESSLEEPDFYKTKIKLCILLHAFRIRAVTIDRVMSYLNAS/*GGGGSGGGGS*/EPKSSDKTHTCPPCPA
PPVAGPSVFLPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK*     (SEQ ID
NO:241)

>XENP29968 human_IL12p40_(GGGGS)2-human_IL12p35(E79Q/N151D)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q

**Chain 1 (XenD22914) - human_IL12p40_(GGGGS)2_Fc(216)_IgG1_pI(-
)_Isosteric_A_C220S/PVA_/S267K/L368D/K370S**

*IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/*GGGGSGGGGS*/EPKSSDKTHTCPPCPAPPVAGPSVFLPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK*     (SEQ ID NO:47)

**Chain 2 (XenD25917) -
human_IL12p35(E79Q/N151D)_(GGGGS)2_Fc(216)_IgG1_C220S/PVA_/S267K/S364K/E357Q**

*RNLPVATPDPGMFPCLHHSQNLLRAVSNMLQKARQTLEFYPCTSEEIDHEDITKDKTSTVEACLPLELTKNESCL
NSRQTSFITNGSCLASRKTSFMMALCLSSIYEDLKMYQVEFKTMNAKLLMDPKRQIFLDQNMLAVIDELMQALNF
DSETVPQKSSLEEPDFYKTKIKLCILLHAFRIRAVTIDRVMSYLNAS/*GGGGSGGGGS*/EPKSSDKTHTCPPCPA
PPVAGPSVFLPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK*     (SEQ ID
NO:242)

Figure 34K

>XENP29969 human_IL12p40_(GGGGS)2-human_IL12p35(D55Q/N151D)_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD22914) - human_IL12p40_(GGGGS)2_Fc(216)_IgG1_pI(-)_Isosteric_A_C220S/PVA_/S267K/L368D/K370S IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK   (SEQ ID NO:47)

Chain 2 (XenD25918) - human_IL12p35(D55Q/N151D)_(GGGGS)2_Fc(216)_IgG1_C220S/PVA_/S267K/S364K/E357Q RNLPVATPDPGMFPCLHHSQNLLRAVSNMLQKARQTLEFYPCTSEEIDHEDITKQKTSTVEACLPLELTKNESCL
NSRETSFITNGSCLASRKTSFMMALCLSSIYEDLKMYQVEFKTMNAKLLMDPKRQIFLDQNMLAVIDELMQALNF
DSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK   (SEQ ID NO:243)

>XENP29970 human_IL12p40_(GGGGS)2-human_IL12p35(N136D/N151D)_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD22914) - human_IL12p40_(GGGGS)2_Fc(216)_IgG1_pI(-)_Isosteric_A_C220S/PVA_/S267K/L368D/K370S IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK   (SEQ ID NO:47)

Chain 2 (XenD25919) - human_IL12p35(N136D/N151D)_(GGGGS)2_Fc(216)_IgG1_C220S/PVA_/S267K/S364K/E357Q RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQDMLAVIDELMQALNF
DSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK   (SEQ ID NO:244)

Figure 34L

>XENP29971 human_IL12p40_(GGGGS)2-human_IL12p35(N21D/N151D)_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD22914) - human_IL12p40_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK*   (SEQ ID NO:47)

Chain 2 (XenD25920) - human_IL12p35(N21D/N151D)_(GGGGS)2_Fc(216)_IgG1_C220S/PVA_/S267K/S364K/E357Q

*RNLPVATPDPGMFPCLHHSQDLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
DSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK*   (SEQ ID NO:245)

>XENP29972 human_IL12p40_(GGGGS)2-human_IL12p35(E143Q/N151D)_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD22914) - human_IL12p40_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK*   (SEQ ID NO:47)

Chain 2 (XenD25921) - human_IL12p35(E143Q/N151D)_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDQLMQALNF
DSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK*   (SEQ ID NO:246)

Figure 37

| XENP | IL-12p40 Variant | IL-12p35 Variant | PSTAT4 EC50 | | FOLD DECREASE IN EC50 | |
|---|---|---|---|---|---|---|
| | | | CD4+ CD45RA+ CD25+ | CD8+ CD45RA+ CD25+ | CD4+ CD45RA+ CD25+ | CD8+ CD45RA+ CD25+ |
| 27201 | WT | WT | 0.08704 | 0.1286 | | |
| 28825 | E59Q | WT | 0.1737 | 0.2259 | 2.00 | 1.76 |
| 28830 | Q56E/E59Q | WT | 0.3278 | 0.41 | 3.77 | 3.19 |
| 28846 | WT | N151D | 0.05648 | 0.08265 | 0.65 | 0.64 |
| 29949 | E59Q | N151D | 0.2748 | 0.3765 | 3.16 | 2.93 |
| 29950 | Q56E/E59Q | N151D | 0.2794 | 0.3592 | 3.21 | 2.79 |
| 29951 | E59K | N151D | 0.9019 | 1.195 | 10.36 | 9.29 |
| 29952 | E59K | WT | 1.012 | 1.547 | 11.63 | 12.03 |
| 29953 | E32Q/E59Q | WT | 0.3248 | 0.4581 | 3.73 | 3.56 |
| 29954 | D34N/E59Q | WT | 0.4004 | 0.5114 | 4.60 | 3.98 |
| 29955 | E59Q/E187Q | WT | 0.2823 | 0.3446 | 3.24 | 2.68 |
| 29956 | S43E/E59Q | WT | 0.2149 | 0.2776 | 2.47 | 2.16 |
| 29957 | S43K/E59Q | WT | N/A | N/A | N/A | N/A |
| 29958 | E59Q/K163E | WT | 0.2182 | 0.2643 | 2.51 | 2.06 |
| 29959 | E59Q/K99E | WT | 0.4892 | 0.6045 | 5.62 | 4.70 |
| 29960 | E59Q/K258E | WT | 0.2553 | 0.2885 | 2.93 | 2.24 |
| 29961 | E59Q/K260E | WT | 0.3782 | 0.4094 | 4.35 | 3.18 |
| 29962 | WT | N151D/E153Q | 0.09898 | 0.128 | 1.14 | 1.00 |
| 29963 | WT | E153K | 0.1044 | 0.1458 | 1.20 | 1.13 |
| 29964 | WT | N151K | 0.07835 | 0.1011 | 0.90 | 0.79 |
| 29965 | WT | N151D/D165N | 0.08989 | 0.118 | 1.03 | 0.92 |
| 29966 | WT | Q130E/N151D | 0.06791 | 0.1092 | 0.78 | 0.85 |
| 29967 | WT | N151D/K158E | 0.1255 | 0.1984 | 1.44 | 1.54 |
| 29968 | WT | E79Q/N151D | 0.1367 | 0.1862 | 1.57 | 1.45 |
| 29969 | WT | D55Q/N151D | 0.1769 | 0.2245 | 2.03 | 1.75 |
| 29970 | WT | N136D/N151D | 0.145 | 0.188 | 1.67 | 1.46 |
| 29971 | WT | N21D/N151D | 0.1043 | 0.1561 | 1.20 | 1.21 |
| 29972 | WT | E143Q/N151D | 0.1426 | 0.1919 | 1.64 | 1.49 |

Figure 38

>IL12p40(E59K/K99E) (SEQ ID NO:325)
IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

>IL12p40(D34N/E59K) (SEQ ID NO:326)
IWELKKDVYVVELDWYPDAPGEMVVLTCDTPEENGITWTLDQSSEVLGSGKTLTIQVKKFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

>IL12p40(D34N/E59K/K99E) (SEQ ID NO:327)
IWELKKDVYVVELDWYPDAPGEMVVLTCDTPEENGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

>IL12p40(D34K/E59K/K99E) (SEQ ID NO:328)
IWELKKDVYVVELDWYPDAPGEMVVLTCDTPEEKGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

>IL12p40(E32Q/D34N/E59K/K99E) (SEQ ID NO:329)
IWELKKDVYVVELDWYPDAPGEMVVLTCDTPQENGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

>IL12p40(E32Q/D34K/E59K/K99E) (SEQ ID NO:330)
IWELKKDVYVVELDWYPDAPGEMVVLTCDTPQEKGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

>IL12p40(E32K/D34N/E59K/K99E) (SEQ ID NO:331)
IWELKKDVYVVELDWYPDAPGEMVVLTCDTPKENGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

>IL12p40(E32K/D34K/E59K/K99E) (SEQ ID NO:332)
IWELKKDVYVVELDWYPDAPGEMVVLTCDTPKEKGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

Figure 39

>IL12p35(D55Q) (SEQ ID NO:333)
RNLPVATPDPGMFPCLHHSQNLLRAVSNMLQKARQTLEFYPCTSEEIDHEDITKQKTSTVEACLPLEL
TKNESCLNSRETSFITNGSCLASRKTSFMMALCLSSIYEDLKMYQVEFKTMNAKLLMDPKRQIFLDQN
MLAVIDELMQALNFNSETVPQKSSLEEPDFYKTKIKLCILLHAFRIRAVTIDRVMSYLNAS

>IL12p35(D55K) (SEQ ID NO:334)
RNLPVATPDPGMFPCLHHSQNLLRAVSNMLQKARQTLEFYPCTSEEIDHEDITKKKTSTVEACLPLEL
TKNESCLNSRETSFITNGSCLASRKTSFMMALCLSSIYEDLKMYQVEFKTMNAKLLMDPKRQIFLDQN
MLAVIDELMQALNFNSETVPQKSSLEEPDFYKTKIKLCILLHAFRIRAVTIDRVMSYLNAS

Figure 40A

>XENP30597 human_IL12p40_E59K/K99E_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD26411) - human_IL12p40_E59K/K99E_(GGGGS)2_Fc(216)_IgG1_pI(-)_Isosteric_A_C220S/PVA_/S267K/L368D/K370S
*IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/*GGGGSGGGGS*/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK*  (SEQ ID NO:291)

Chain 2 (XenD22915) - human_IL12p35_(GGGGS)2_Fc(216)_IgG1_C220S/PVA_/S267K/S364K/E357Q
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/*GGGGSGGGGS*/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK*  (SEQ ID NO:443)

>XENP30598 human_IL12p40_D34N/E59K_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD26412) - human_IL12p40_D34N/E59K_(GGGGS)2_Fc(216)_IgG1_pI(-)_Isosteric_A_C220S/PVA_/S267K/L368D/K370S
*IWELKKDVYVVELDWYPDAPGEMVVLTCDTPEENGITWTLDQSSEVLGSGKTLTIQVKKFGDAGQYTCHKGGEVLSHSL
LLLHKKEDGIWSTDILKDQKEPKNKTFLRCEAKNYSGRFTCWWLTTISTDLTFSVKSSRGSSDPQGVTCGAATLSAERV
RGDNKEYEYSVECQEDSACPAAEESLPIEVMVDAVHKLKYENYTSSFFIRDIIKPDPPKNLQLKPLKNSRQVEVSWEYP
DTWSTPHSYFSLTFCVQVQGKSKREKKDRVFTDKTSATVICRKNASISVRAQDRYYSSSWSEWASVPCS/*GGGGSGGGG
S*/EPKSSDKTHTCPPCPAPPVAGPSVFLFPPKPKDTLMISRTPEVTCVVVDVKHEDPEVKFNWYVDGVEVHNAKTKPRE
EEYNSTYRVVSVLTVLHQDWLNGKEYKCKVSNKALPAPIEKTISKAKGQPREPQVYTLPPSREEMTKNQVSLTCDVSGF
YPSDIAVEWESDGQPENNYKTTPPVLDSDGSFFLYSKLTVDKSRWEQGDVFSCSVMHEALHNHYTQKSLSLSPGK*
(SEQ ID NO:292)

Chain 2 (XenD22915) - human_IL12p35_(GGGGS)2_Fc(216)_IgG1_C220S/PVA_/S267K/S364K/E357Q
*RNLPVATPDPGMFPCLHHSQNLLRAVSNMLQKARQTLEFYPCTSEEIDHEDITKDKTSTVEACLPLELTKNESCLNSRE
TSFITNGSCLASRKTSFMMALCLSSIYEDLKMYQVEFKTMNAKLLMDPKRQIFLDQNMLAVIDELMQALNFNSETVPQK
SSLEEPDFYKTKIKLCILLHAFRIRAVTIDRVMSYLNAS/*GGGGSGGGGS*/EPKSSDKTHTCPPCPAPPVAGPSVFLFP
PKPKDTLMISRTPEVTCVVVDVKHEDPEVKFNWYVDGVEVHNAKTKPREEQYNSTYRVVSVLTVLHQDWLNGKEYKCKV
SNKALPAPIEKTISKAKGQPREPQVYTLPPSREQMTKNQVKLTCLVKGFYPSDIAVEWESNGQPENNYKTTPPVLDSDG
SFFLYSKLTVDKSRWQQGNVFSCSVMHEALHNHYTQKSLSLSPGK*  (SEQ ID NO:444)

Figure 40B

>XENP30599_human_IL12p40_D34N/E59K/K99E_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD26413) - human_IL12p40_D34N/E59K/K99E_(GGGGS)2_Fc(216)_IgG1_pI(-)_Isosteric_A_C220S/PVA_/S267K/L368D/K370S IWELKKDVYVVELDWYPDAPGEMVVLTCDTPEENGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK    (SEQ ID NO:293)

Chain 2 (XenD22915) - human_IL12p35_(GGGGS)2_Fc(216)_IgG1_C220S/PVA_/S267K/S364K/E357Q RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK    (SEQ ID
NO:445)

>XENP30600_human_IL12p40_D34K/E59K/K99E_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD26414) - human_IL12p40_D34K/E59K/K99E_(GGGGS)2_Fc(216)_IgG1_pI(-)_Isosteric_A_C220S/PVA_/S267K/L368D/K370S IWELKKDVYVVELDWYPDAPGEMVVLTCDTPEEKGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK    (SEQ ID NO:294)

Chain 2 (XenD22915) - human_IL12p35_(GGGGS)2_Fc(216)_IgG1_C220S/PVA_/S267K/S364K/E357Q RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK    (SEQ ID
NO:446)

Figure 40C

>XENP30601_human_IL12p40_E32Q/D34N/E59K/K99E_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD26415) - human_IL12p40_E32Q/D34N/E59K/K99E_(GGGGS)2_Fc(216)_IgG1_pI(-)_Isosteric_A_C220S/PVA_/S267K/L368D/K370S IWELKKDVYVVELDWYPDAPGEMVVLTCDTPQENGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK (SEQ ID NO:295)

Chain 2 (XenD22915) - human_IL12p35_(GGGGS)2_Fc(216)_IgG1_C220S/PVA_/S267K/S364K/E357Q RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:447)

>XENP30602_human_IL12p40_E32Q/D34K/E59K/K99E_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD26416) - human_IL12p40_E32Q/D34K/E59K/K99E_(GGGGS)2_Fc(216)_IgG1_pI(-)_Isosteric_A_C220S/PVA_/S267K/L368D/K370S IWELKKDVYVVELDWYPDAPGEMVVLTCDTPQEKGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK (SEQ ID NO:296)

Chain 2 (XenD22915) - human_IL12p35_(GGGGS)2_Fc(216)_IgG1_C220S/PVA_/S267K/S364K/E357Q RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:448)

Figure 40D

>XENP30603 human_IL12p40_E32K/D34N/E59K/K99E_(GGGGS)2-human_IL12p35_(GGGGS)2-
Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD26417) - human_IL12p40_E32K/D34N/E59K/K99E_(GGGGS)2_Fc(216)_IgG1_pI(-
)_Isosteric_A_C220S/PVA_/S267K/L368D/K370S IWELKKDVYVVELDWYPDAPGEMVVLTCDTPKENGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK  (SEQ ID NO:297)

Chain 2 (XenD22915) - human_IL12p35_(GGGGS)2_Fc(216)_IgG1_C220S/PVA_/S267K/S364K/E357Q RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK  (SEQ ID
NO:449)

>XENP30604 human_IL12p40_E32K/D34K/E59K/K99E_(GGGGS)2-human_IL12p35_(GGGGS)2-
Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD26418) - human_IL12p40_E32K/D34K/E59K/K99E_(GGGGS)2_Fc(216)_IgG1_pI(-
)_Isosteric_A_C220S/PVA_/S267K/L368D/K370S IWELKKDVYVVELDWYPDAPGEMVVLTCDTPKEKGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK  (SEQ ID NO:298)

Chain 2 (XenD22915) - human_IL12p35_(GGGGS)2_Fc(216)_IgG1_C220S/PVA_/S267K/S364K/E357Q RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK  (SEQ ID
NO:450)

Figure 40E

>XENP30605_human_IL12p40_E32Q/D34N/E59K/K99E_(GGGGS)2-human_IL12p35_D55Q_(GGGGS)2-
Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD26415) - human_IL12p40_E32Q/D34N/E59K/K99E_(GGGGS)2_Fc(216)_IgG1_pI(-
)_Isosteric_A_C220S/PVA_/S267K/L368D/K370S
IWELKKDVYVVELDWYPDAPGEMVVLTCDTPQENGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK  (SEQ ID NO:295)

Chain 2 (XenD26427) - human_IL12p35_D55Q_(GGGGS)2_Fc(216)_IgG1_C220S/PVA_/S267K/S364K/E357Q
RNLPVATPDPGMFPCLHHSQNLLRAVSNMLQKARQTLEFYPCTSEEIDHEDITKQKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK  (SEQ ID
NO:299)

>XENP30606_human_IL12p40_E32Q/D34K/E59K/K99E_(GGGGS)2-human_IL12p35_D55Q_(GGGGS)2-
Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD26416) - human_IL12p40_E32Q/D34K/E59K/K99E_(GGGGS)2_Fc(216)_IgG1_pI(-
)_Isosteric_A_C220S/PVA_/S267K/L368D/K370S
IWELKKDVYVVELDWYPDAPGEMVVLTCDTPQEKGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK  (SEQ ID NO:296)

Chain 2 (XenD26427) - human_IL12p35_D55Q_(GGGGS)2_Fc(216)_IgG1_C220S/PVA_/S267K/S364K/E357Q
RNLPVATPDPGMFPCLHHSQNLLRAVSNMLQKARQTLEFYPCTSEEIDHEDITKQKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK  (SEQ ID
NO:299)

Figure 40F

>XENP30607_human_IL12p40_E32K/D34N/E59K/K99E_(GGGGS)2-human_IL12p35_D55Q_(GGGGS)2-
Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD26417) - human_IL12p40_E32K/D34N/E59K/K99E_(GGGGS)2_Fc(216)_IgG1_pI(-
)_Isosteric_A_C220S/PVA_/S267K/L368D/K370S

*IWELKKDVYVVELDWYPDAPGEMVVLTCDTPKENGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:297)

Chain 2 (XenD26427) - human_IL12p35_D55Q_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKQKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID
NO:299)

>XENP30608_human_IL12p40_E32K/D34K/E59K/K99E_(GGGGS)2-human_IL12p35_D55Q_(GGGGS)2-
Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD26418) - human_IL12p40_E32K/D34K/E59K/K99E_(GGGGS)2_Fc(216)_IgG1_pI(-
)_Isosteric_A_C220S/PVA_/S267K/L368D/K370S

*IWELKKDVYVVELDWYPDAPGEMVVLTCDTPKEKGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:298)

Chain 2 (XenD26427) - human_IL12p35_D55Q_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKQKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID
NO:299)

Figure 40G

>XENP30609 human_IL12p40_E32K/D34K/E59K/K99E_(GGGGS)2-human_IL12p35_D55K_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD26418) - human_IL12p40_E32K/D34K/E59K/K99E_(GGGGS)2_Fc(216)_IgG1_pI(-)_Isosteric_A_C220S/PVA_/S267K/L368D/K370S

*IWELKKDVYVVELDWYPDAPGEMVVLTCDTPKEKGITWTLDQSSEVLGSGKTLTIQVKKFGDAGQYTCHKGGEVL*
*SHSLLLLHKKEDGIWSTDILKDQEEPKNKTFLRCEAKNYSGRFTCWWLTTISTDLTFSVKSSRGSSDPQGVTCGA*
*ATLSAERVRGDNKEYEYSVECQEDSACPAAEESLPIEVMVDAVHKLKYENYTSSFFIRDIIKPDPPKNLQLKPLK*
*NSRQVEVSWEYPDTWSTPHSYFSLTFCVQVQGKSKREKKDRVFTDKTSATVICRKNASISVRAQDRYYSSSWSEW*
*ASVPCS*/GGGGSGGGGS/*EPKSSDKTHTCPPCPAPPVAGPSVFLFPPKPKDTLMISRTPEVTCVVVDVKHEDPEV*
*KFNWYVDGVEVHNAKTKPREEEYNSTYRVVSVLTVLHQDWLNGKEYKCKVSNKALPAPIEKTISKAKGQPREPQV*
*YTLPPSREEMTKNQVSLTCDVSGFYPSDIAVEWESDGQPENNYKTTPPVLDSDGSFFLYSKLTVDKSRWEQGDVF*
*SCSVMHEALHNHYTQKSLSLSPGK* (SEQ ID NO:298)

Chain 2 (XenD26428) - human_IL12p35_D55K_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKKKTSTVEACLPLELTKNESCL*
*NSRETSFITNGSCLASRKTSFMMALCLSSIYEDLKMYQVEFKTMNAKLLMDPKRQIFLDQNMLAVIDELMQALNF*
*NSETVPQKSSLEEPDFYKTKIKLCILLHAFRIRAVTIDRVMSYLNAS*/GGGGSGGGGS/*EPKSSDKTHTCPPCPA*
*PPVAGPSVFLFPPKPKDTLMISRTPEVTCVVVDVKHEDPEVKFNWYVDGVEVHNAKTKPREEEYNSTYRVVSVLT*
*VLHQDWLNGKEYKCKVSNKALPAPIEKTISKAKGQPREPQVYTLPPSREQMTKNQVKLTCLVKGFYPSDIAVEWE*
*SNGQPENNYKTTPPVLDSDGSFFLYSKLTVDKSRWQQGNVFSCSVMHEALHNHYTQKSLSLSPGK* (SEQ ID NO:300)

Figure 42

| XENP | IL-12p40 Variant | IL-12p35 Variant | PSTAT4 EC50 | | FOLD DECREASE IN EC50 | |
|---|---|---|---|---|---|---|
| | | | CD4+ CD45RA+ CD25+ | CD8+ CD45RA+ CD25+ | CD4+ CD45RA+ CD25+ | CD8+ CD45RA+ CD25+ |
| 27201 | WT | WT | 0.1101 | 0.2097 | | |
| 29952 | E59K | WT | 1.056 | 1.287 | 9.59 | 6.14 |
| 30597 | E59K/K99E | WT | 5.507 | 9.768 | 50.02 | 46.58 |
| 30598 | D34N/E59K | WT | 1.308 | 1.806 | 11.88 | 8.61 |
| 30599 | D34N/E59K/K99E | WT | 3.23 | 4.839 | 29.34 | 23.08 |
| 30600 | D34K/E59K/K99E | WT | 5.929 | 9.898 | 53.85 | 47.20 |
| 30601 | E32Q/D34N/E59K/K99E | WT | 6.804 | 11.71 | 61.80 | 55.84 |
| 30602 | E32Q/D34K/E59K/K99E | WT | 2.714 | 3.645 | 24.65 | 17.38 |
| 30603 | E32K/D34N/E59K/K99E | WT | 1.13 | 1.482 | 10.26 | 7.07 |
| 30604 | E32K/D34K/E59K/K99E | WT | 8.44 | 12.98 | 76.66 | 61.90 |
| 30607 | E32K/D34N/E59K/K99E | D55Q | 12.1 | 24.31 | 109.90 | 115.93 |
| 30608 | E32K/D34K/E59K/K99E | D55Q | 10.25 | 25.27 | 93.10 | 120.51 |
| 30609 | E32K/D34K/E59K/K99E | D55K | 5.426 | 8.258 | 49.28 | 39.38 |

Figure 43A

>IL12p40 (E59Y/K99E) (SEQ ID NO:335)
IWELKKDVYVVELDWYPDAPGEMVVLTCDTPEEDGITWTLDQSSEVLGSGKTLTIQVKYFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

>IL12p40 (E59K/K99Y) (SEQ ID NO:336)
IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQYEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

>IL12p40 (E59Y/K99Y) (SEQ ID NO:337)
IWELKKDVYVVELDWYPDAPGEMVVLTCDTPEEDGITWTLDQSSEVLGSGKTLTIQVKYFGDAGQYTCHKGGEVL
SHSLLLLHKKEDGIWSTDILKDQYEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

>IL12p40 (E45K/E59K/K99E) (SEQ ID NO:338)
IWELKKDVYVVELDWYPDAPGEMVVLTCDTPEEDGITWTLDQSSKVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

>IL12p40 (D18K/E59K/K99E) (SEQ ID NO:339)
IWELKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

>IL12p40 (E59K/K99E/Q144E) (SEQ ID NO:340)
IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPEGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

>IL12p40 (E59K/K99E/Q144K) (SEQ ID NO:341)
IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPKGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

Figure 43B

>IL12p40 (E59K/K99E/R159E) (SEQ ID NO:342)
IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVEGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS

>IL12p40 (E59K/K99E/K264E) (SEQ ID NO:343)
IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKEDRVFTDKTSATVICRKNASISVRAQDRYYSSSWSEW
ASVPCS

>IL12p40 (D18K/E59K/K99E/K264E) (SEQ ID NO:344)
IWELKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKEDRVFTDKTSATVICRKNASISVRAQDRYYSSSWSEW
ASVPCS

Figure 44

>IL12p35(F96A) (SEQ ID NO:345)
RNLPVATPDPGMFPCLHHSQNLLRAVSNMLQKARQTLEFYPCTSEEIDHEDITKDKTSTVEACLPLELTKNESCL
NSRETSFITNGSCLASRKTSAMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS

>IL12p35(M97A) (SEQ ID NO:346)
RNLPVATPDPGMFPCLHHSQNLLRAVSNMLQKARQTLEFYPCTSEEIDHEDITKDKTSTVEACLPLELTKNESCL
NSRETSFITNGSCLASRKTSFAMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS

>IL12p35(L89A) (SEQ ID NO:347)
RNLPVATPDPGMFPCLHHSQNLLRAVSNMLQKARQTLEFYPCTSEEIDHEDITKDKTSTVEACLPLELTKNESCL
NSRETSFITNGSCAASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS

>IL12p35(L124A) (SEQ ID NO:348)
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLAMDPKRQIFLDQNMLAVIDELMQALNF
NSETVPQKSSLEEPDFYKTKIKLCILLHAFRIRAVTIDRVMSYLNAS

>IL12p35(M125A) (SEQ ID NO:349)
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLADPKRQIFLDQNMLAVIDELMQALNF
NSETVPQKSSLEEPDFYKTKIKLCILLHAFRIRAVTIDRVMSYLNAS

>IL12p35(L75A) (SEQ ID NO:350)
RNLPVATPDPGMFPCLHHSQNLLRAVSNMLQKARQTLEFYPCTSEEIDHEDITKDKTSTVEACLPLELTKNESCA
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS

>IL12p35(I171A) (SEQ ID NO:351)
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKAKLCILLHAFRIRAVTIDRVMSYLNAS

Figure 45A

>XENP31250 human_IL12p40(E59Y/K99E)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD27070) - human_IL12p40(E59Y/K99E)_(GGGGS)2_Fc(216)_IgG1_pI(-)_Isosteric_A_C220S/PVA_/S267K/L368D/K370S IWELKKDVYVVELDWYPDAPGEMVVLTCDTPEEDGITWTLDQSSEVLGSGKTLTIQVKYFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK      (SEQ ID NO:301)

Chain 2 (XenD22915) - human_IL12p35_(GGGGS)2_Fc(216)_IgG1_C220S/PVA_/S267K/S364K/E357Q RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK     (SEQ ID
NO:451)

>XENP31251 human_IL12p40(E59K/K99Y)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD27071) - human_IL12p40(E59K/K99Y)_(GGGGS)2_Fc(216)_IgG1_pI(-)_Isosteric_A_C220S/PVA_/S267K/L368D/K370S IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQYEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK     (SEQ ID NO:302)

Chain 2 (XenD22915) - human_IL12p35_(GGGGS)2_Fc(216)_IgG1_C220S/PVA_/S267K/S364K/E357Q RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK     (SEQ ID
NO:452)

Figure 45B

>XENP31252 human_IL12p40(E59Y/K99Y)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q

**Chain 1 (XenD27072) - human_IL12p40(E59Y/K99Y)_(GGGGS)2_Fc(216)_IgG1_pI(-
)_Isosteric_A_C220S/PVA_/S267K/L368D/K370S**

*IWELKKDVYVVELDWYPDAPGEMVVLTCDTPEEDGITWTLDQSSEVLGSGKTLTIQVKYFGDAGQYTCHKGGEVL
SHSLLLLHKKEDGIWSTDILKDQYEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/*GGGGSGGGGS/*EPKSSDKTHTCPPCPAPPVAGPSVFLPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:303)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/*GGGGSGGGGS/*EPKSSDKTHTCPPCPA
PPVAGPSVFLPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID
NO:453)

>XENP31253 human_IL12p40(E45K/E59K/K99E)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q

**Chain 1 (XenD27073) - human_IL12p40(E45K/E59K/K99E)_(GGGGS)2_Fc(216)_IgG1_pI(-
)_Isosteric_A_C220S/PVA_/S267K/L368D/K370S**

*IWELKKDVYVVELDWYPDAPGEMVVLTCDTPEEDGITWTLDQSSKVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/*GGGGSGGGGS/*EPKSSDKTHTCPPCPAPPVAGPSVFLPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:304)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/*GGGGSGGGGS/*EPKSSDKTHTCPPCPA
PPVAGPSVFLPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID
NO:454)

Figure 45C

>XENP31254_human_IL12p40(D18K/E59K/K99E)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD27074) - human_IL12p40(D18K/E59K/K99E)_(GGGGS)2_Fc(216)_IgG1_pI(-)_Isosteric_A_C220S/PVA_/S267K/L368D/K370S

*IWELKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/<u>GGGGSGGGGS</u>/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:305)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/<u>GGGGSGGGGS</u>/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:455)

>XENP31255_human_IL12p40(E59K/K99E/Q144E)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD27075) - human_IL12p40(E59K/K99E/Q144E)_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPEGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/<u>GGGGSGGGGS</u>/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:306)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/<u>GGGGSGGGGS</u>/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:456)

Figure 45D

>XENP31256 human_IL12p40(E59K/K99E/Q144K)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD27076) - human_IL12p40(E59K/K99E/Q144K)_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPKGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:307)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:458)

>XENP31257 human_IL12p40(E59K/K99E/R159E)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD27077) - human_IL12p40(E59K/K99E/R159E)_(GGGGS)2_Fc(216)_IgG1_pI(-)_Isosteric_A_C220S/PVA_/S267K/L368D/K370S

*IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVEGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK* (SEQ ID NO:308)

Chain 2 (XenD22915) - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO:459)

Figure 45E

>XENP31258 human_IL12p40(E59K/K99E/K264E)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD27078) - human_IL12p40(E59K/K99E/K264E)_(GGGGS)2_Fc(216)_IgG1_pI(-)_Isosteric_A_C220S/PVA_/S267K/L368D/K370S IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKEDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK (SEQ ID NO:309)

Chain 2 (XenD22915) - human_IL12p35_(GGGGS)2_Fc(216)_IgG1_C220S/PVA_/S267K/S364K/E357Q RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK (SEQ ID
NO:460)

>XENP31259 human_IL12p40(E59K/K99E)_(GGGGS)2-human_IL12p35(F96A)_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD26411) - human_IL12p40(E59K/K99E)_(GGGGS)2_Fc(216)_IgG1_pI(-)_Isosteric_A_C220S/PVA_/S267K/L368D/K370S IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK (SEQ ID NO:291)

Chain 2 (XenD27088) - human_IL12p35(F96A)_(GGGGS)2_Fc(216)_IgG1_C220S/PVA_/S267K/S364K/E357Q RNLPVATPDPGMFPCLHHSQNLLRAVSNMLQKARQTLEFYPCTSEEIDHEDITKDKTSTVEACLPLELTKNESCL
NSRETSFITNGSCLASRKTSAMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK (SEQ ID
NO:310)

Figure 45F

>XENP31260 human_IL12p40(E59K/K99E)_(GGGGS)2-human_IL12p35(M97A)_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD26411) - human_IL12p40(E59K/K99E)_(GGGGS)2_Fc(216)_IgG1_pI(-)_Isosteric_A_C220S/PVA_/S267K/L368D/K370S IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK (SEQ ID NO:291)

Chain 2 (XenD27089) - human_IL12p35(M97A)_(GGGGS)2_Fc(216)_IgG1_C220S/PVA_/S267K/S364K/E357Q RNLPVATPDPGMFPCLHHSQNLLRAVSNMLQKARQTLEFYPCTSEEIDHEDITKDKTSTVEACLPLELTKNESCL
NSRETSFITNGSCLASRKTSFAMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:311)

>XENP31261 human_IL12p40(E59K/K99E)_(GGGGS)2-human_IL12p35(L89A)_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD26411) - human_IL12p40(E59K/K99E)_(GGGGS)2_Fc(216)_IgG1_pI(-)_Isosteric_A_C220S/PVA_/S267K/L368D/K370S IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK (SEQ ID NO:291)

Chain 2 (XenD27090) - human_IL12p35(L89A)_(GGGGS)2_Fc(216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCL
NSRETSFITNGSCAASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:312)

Figure 45G

>XENP31262 human_IL12p40(E59K/K99E)_(GGGGS)2-human_IL12p35(L124A)_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD26411) - human_IL12p40(E59K/K99E)_(GGGGS)2_Fc(216)_IgG1_pI(-)_Isosteric_A_C220S/PVA_/S267K/L368D/K370S IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK    (SEQ ID NO:291)

Chain 2 (XenD27091) - human_IL12p35(L124A)_(GGGGS)2_Fc(216)_IgG1_C220S/PVA_/S267K/S364K/E357Q RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLAMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK    (SEQ ID
NO:313)

>XENP31263 human_IL12p40(E59K/K99E)_(GGGGS)2-human_IL12p35(M125A)_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 (XenD26411) - human_IL12p40(E59K/K99E)_(GGGGS)2_Fc(216)_IgG1_pI(-)_Isosteric_A_C220S/PVA_/S267K/L368D/K370S IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK    (SEQ ID NO:291)

Chain 2 (XenD27092) - human_IL12p35(M125A)_(GGGGS)2_Fc(216)_IgG1_C220S/PVA_/S267K/S364K/E357Q RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLADPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK    (SEQ ID
NO:314)

Figure 45H

>XENP31264 human_IL12p40(E59K/K99E)_(GGGGS)2-human_IL12p35(L75A)_(GGGGS)2-Fc(216)_IgG1_pl(-)_Isosteric_A_C220S/PVA_/S267K/L368D/K370S_Fc(216)_IgG1_C220S/PVA_/S267K/S364K/E357Q

Chain 1 (XenD26411) - human_IL12p40(E59K/K99E)_(GGGGS)2_Fc(216)_IgG1_pl(-)_Isosteric_A_C220S/PVA_/S267K/L368D/K370S IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK (SEQ ID NO:291)

Chain 2 (XenD27093) - human_IL12p35(L57A)_(GGGGS)2_Fc(216)_IgG1_C220S/PVA_/S267K/S364K/E357Q RNLPVATPDPGMFPCLHHSQNLLRAVSNMLQKARQTLEFYPCTSEEIDHEDITKDKTSTVEACLPLELTKNESCA
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:315)

>XENP31265 human_IL12p40(E59K/K99E)_(GGGGS)2-human_IL12p35(I171A)_(GGGGS)2-Fc(216)_IgG1_pl(-)_Isosteric_A_C220S/PVA_/S267K/L368D/K370S_Fc(216)_IgG1_C220S/PVA_/S267K/S364K/E357Q

Chain 1 (XenD26411) - human_IL12p40(E59K/K99E)_(GGGGS)2_Fc(216)_IgG1_pl(-)_Isosteric_A_C220S/PVA_/S267K/L368D/K370S IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK (SEQ ID NO:291)

Chain 2 (XenD27094) - human_IL12p35(I171A)_(GGGGS)2_Fc(216)_IgG1_C220S/PVA_/S267K/S364K/E357Q RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKAKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO:316)

Figure 45I

\>XENP32186_human_IL12p40(D18K/E59K/K99E/K264E)_(GGGGS)2-human_IL12p35_(GGGGS)2-
Fc(216)_IgG1_pI(-
)_Isosteric_A_C220S/PVA_/S267K/L368D/K370S_Fc(216)_IgG1_C220S/PVA_/S267K/S364K/E357Q Chain 1 (XenD28173) - human_IL12p40(D18K/E59K/K99E/K264E)_(GGGGS)2_Fc(216)_IgG1_pI(-
)_Isosteric_A_C220S/PVA_/S267K/L368D/K370S
IWELKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKEDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK (SEQ ID NO:317)

Chain 2 (XenD22915) - human_IL12p35_(GGGGS)2_Fc(216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK (SEQ ID
NO:461)

Figure 46A

>XENP31142 human_IL12p40_(GGGGS)2-human_IL12p35_(GGGGS)2-Fc(216)_IgG1_pI(-
)_Isosteric_A_C220S/PVA_/S267K/L368D/K370S/M428L/N434S-
IgG1_PVA_/S267K/S364K/E357Q/M428L/N434S Chain 1 (XenD24876) - human_IL12p40_(GGGGS)2_Fc(216)_IgG1_pI(-
)_Isosteric_A_C220S/PVA_/S267K/L368D/K370S/M428L/N434S
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVLHEALHSHYTQKSLSLSPGK    (SEQ ID NO:318)

Chain 2 (XenD24877) - human_IL12p35_(GGGGS)2_IgG1_PVA_/S267K/S364K/E357Q/M428L/N434S
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVLHEALHSHYTQKSLSLSPGK    (SEQ ID
NO:319)

>XENP31143 human_IL12p40_E32Q/D34N/E59K/K99E_(GGGGS)2-human_IL12p35_(GGGGS)2-
Fc(216)_IgG1_pI(-)_Isosteric_A_C220S/PVA_/S267K/L368D/K370S/M428L/N434S-
IgG1_PVA_/S267K/S364K/E357Q/M428L/N434S Chain 1 (XenD27162) - human_IL12p40_E32Q/D34N/E59K/K99E_(GGGGS)2_Fc(216)_IgG1_pI(-
)_Isosteric_A_C220S/PVA_/S267K/L368D/K370S/M428L/N434S
IWELKKDVYVVELDWYPDAPGEMVVLTCDTPQENGITWTLDQSSEVLGSGKTLTIQVKEFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVLHEALHSHYTQKSLSLSPGK    (SEQ ID NO:320)

Chain 2 (XenD24877) - human_IL12p35_(GGGGS)2_IgG1_PVA_/S267K/S364K/E357Q/M428L/N434S
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVLHEALHSHYTQKSLSLSPGK    (SEQ ID
NO:319)

Figure 46B

>XENP31144 human_IL12p40_E32K/D34N/E59K/K99E_(GGGGS)2-human_IL12p35_D55Q_(GGGGS)2-Fc(216)_IgG1_pI(-)_Isosteric_A_C220S/PVA_/S267K/L368D/K370S/M428L/N434S-IgG1_PVA_/S267K/S364K/E357Q/M428L/N434S

Chain 1 (XenD27163) - human_IL12p40_E32K/D34N/E59K/K99E_(GGGGS)2_Fc(216)_IgG1_pI(-)_Isosteric_A_C220S/PVA_/S267K/L368D/K370S/M428L/N434S

*IWELKKDVYVVELDWYPDAPGEMVVLTCDTPKENGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS*/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVLHEALHSHYTQKSLSLSPGK (SEQ ID NO:321)

Chain 2 (XenD27166) - human_IL12p35_D55Q_(GGGGS)2_IgG1_PVA_/S267K/S364K/E357Q/M428L/N434S

*RNLPVATPDPGMFPCLHHSQNLLRAVSNMLQKARQTLEFYPCTSEEIDHEDITKQKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS*/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVLHEALHSHYTQKSLSLSPGK (SEQ ID NO:322)

>XENP31145 human_IL12p40_E32K/D34K/E59K/K99E_(GGGGS)2-human_IL12p35_D55Q_(GGGGS)2-Fc(216)_IgG1_pI(-)_Isosteric_A_C220S/PVA_/S267K/L368D/K370S/M428L/N434S-IgG1_PVA_/S267K/S364K/E357Q/M428L/N434S

Chain 1 (XenD27164) - human_IL12p40_E32K/D34K/E59K/K99E_(GGGGS)2_Fc(216)_IgG1_pI(-)_Isosteric_A_C220S/PVA_/S267K/L368D/K370S/M428L/N434S

*IWELKKDVYVVELDWYPDAPGEMVVLTCDTPKEKGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS*/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVLHEALHSHYTQKSLSLSPGK (SEQ ID NO:323)

Chain 2 (XenD27166) - human_IL12p35_D55Q_(GGGGS)2_IgG1_PVA_/S267K/S364K/E357Q/M428L/N434S

*RNLPVATPDPGMFPCLHHSQNLLRAVSNMLQKARQTLEFYPCTSEEIDHEDITKQKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS*/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVLHEALHSHYTQKSLSLSPGK (SEQ ID NO:322)

Figure 46C

\>XENP31146 human_IL12p40_E59K/K99E_(GGGGS)2-human_IL12p35_(GGGGS)2-Fc(216)_IgG1_pI(-
)_Isosteric_A_C220S/PVA_/S267K/L368D/K370S/M428L/N434S-
IgG1_PVA_/S267K/S364K/E357Q/M428L/N434S Chain 1 (XenD27165) - human_IL12p40_E59K/K99E_(GGGGS)2_Fc(216)_IgG1_pI(-
)_Isosteric_A_C220S/PVA_/S267K/L368D/K370S/M428L/N434S

*IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/<u>GGGGSGGGGS</u>/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVLHEALHSHYTQKSLSLSPGK* (SEQ ID NO:324)

Chain 2 (XenD24877) - human_IL12p35_(GGGGS)2_IgG1_PVA_/S267K/S364K/E357Q/M428L/N434S

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/<u>GGGGSGGGGS</u>/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVLHEALHSHYTQKSLSLSPGK* (SEQ ID
NO:319)

Figure 48

| XENP | IL-12p40 Variant | IL-12p30 Variant | pSTAT4 EC50 (µg/ml) | | FOLD DECREASE IN EC50 | |
|---|---|---|---|---|---|---|
| | | | CD4+ CD45RA+ CD25+ | CD8+ CD45RA+ CD25+ | CD4+ CD45RA+ CD25+ | CD8+ CD45RA+ CD25+ |
| 27201 | WT | WT | 0.2535 | 0.3516 | | |
| 31250 | E59Y/K99E | WT | 4.767 | 6.049 | 18.80 | 17.20 |
| 31251 | E59K/K99Y | WT | 2.383 | 2.751 | 9.40 | 7.82 |
| 31252 | E59Y/K99Y | WT | 0.8014 | 1.037 | 3.16 | 2.95 |
| 31253 | E45K/E59K/K99E | WT | 8.04 | 7.157 | 31.72 | 20.36 |
| 31254 | D18K/E59K/K99E | WT | 17.75 | 21.89 | 70.02 | 62.26 |
| 31255 | E59K/K99E/Q144E | WT | 4.581 | 5.638 | 18.07 | 16.04 |
| 31256 | E59K/K99E/Q144K | WT | 4.713 | 6.344 | 18.59 | 18.04 |
| 31257 | E59K/K99E/R159E | WT | 5.084 | 6.481 | 20.06 | 18.43 |
| 31258 | E59K/K99E/K264E | WT | 24.15 | 20.38 | 95.27 | 57.96 |
| 31259 | E59K/K99E | F96A | 5.822 | 6.153 | 22.97 | 17.50 |
| 31260 | E59K/K99E | M97A | 4.431 | 4.729 | 17.48 | 13.45 |
| 31261 | E59K/K99E | L89A | 4.067 | 5.22 | 16.04 | 14.85 |
| 31262 | E59K/K99E | L124A | 3.102 | 4.657 | 12.24 | 13.25 |
| 31263 | E59K/K99E | M125A | 11.99 | 11.7 | 47.30 | 33.28 |
| 31264 | E59K/K99E | L75A | 4.112 | 4.49 | 16.22 | 12.77 |
| 31265 | E59K/K99E | I171A | 2.897 | 3.565 | 11.43 | 10.14 |

(scIL-12(p40/p35))₂-Fc
Example: XENP31289

(scIL-12(p35/p40))₂-Fc

Fc-(scIL-12(p40/p35))₂

Fc-(scIL-12(p35/p40))₂

Figure 50

>XENP31289 human_IL12p40_(GGGGS)5-human_IL12p35_(GGGGS)2_Fc(216)_IgG1_pI(-)_Isosteric_A_C220S/PVA_/S267K/L368D/K370S (SEQ ID NO:51)

IWELKKDVYVVELDWYPDAPGEMVVLTCDTPEEDGITWTLDQSSEVLGSGKTLTIQVKEFGDAGQYTCHKGGEVLSHSLLLLHK
KEDGIWSTDILKDQKEPKNKTFLRCEAKNYSGRFTCWWLTTISTDLTFSVKSSRGSSDPQGVTCGAATLSAERVRGDNKEYEYSV
ECQEDSACPAAEESLPIEVMVDAVHKLKYENYTSSFFIRDIIKPDPPKNLQLKPLKNSRQVEVSWEYPDTWSTPHSYFSLTFCVQV
QGKSKREKKDRVFTDKTSATVICRKNASISVRAQDRYYSSSWSEWASVPCS/GGGGSGGGGSGGGGSGGGGSGGGGS/RNLP
VATPDPGMFPCLHHSQNLLRAVSNMLQKARQTLEFYPCTSEEIDHEDITKDKTSTVEACLPLELTKNESCLNSRETSFITNGSCLA
SRKTSFMMALCLSSIYEDLKMYQVEFKTMNAKLLMDPKRQIFLDQNMLAVIDELMQALNFNSETVPQKSSLEEPDFYKTKIKLC
ILLHAFRIRAVTIDRVMSYLNAS/GGGGSGGGGS/EPKSSDKTHTCPPCPAPPVAGPSVFLFPPKPKDTLMISRTPEVTCVVVDVK
HEDPEVKFNWYVDGVEVHNAKTKPREEEYNSTYRVVSVLTVLHQDWLNGKEYKCKVSNKALPAPIEKTISKAKGQPREPQVYT
LPPSREEMTKNQVSLTCDVSGFYPSDIAVEWESDGQPENNYKTTPPVLDSDGSFFLYSKLTVDKSRWEQGDVFSCSVMHEALH
NHYTQKSLSLSPGK

>XENP31291 human_IL12p40(E59K/K99E)_(GGGGS)5-human_IL12p35_(GGGGS)2_Fc(216)_IgG1_pI(-)_Isosteric_A_C220S/PVA_/S267K/L368D/K370S (SEQ ID NO:353)

IWELKKDVYVVELDWYPDAPGEMVVLTCDTPEEDGITWTLDQSSEVLGSGKTLTIQVKKFGDAGQYTCHKGGEVLSHSLLLLH
KKEDGIWSTDILKDQEEPKNKTFLRCEAKNYSGRFTCWWLTTISTDLTFSVKSSRGSSDPQGVTCGAATLSAERVRGDNKEYEYS
VECQEDSACPAAEESLPIEVMVDAVHKLKYENYTSSFFIRDIIKPDPPKNLQLKPLKNSRQVEVSWEYPDTWSTPHSYFSLTFCVQ
VQGKSKREKKDRVFTDKTSATVICRKNASISVRAQDRYYSSSWSEWASVPCS/GGGGSGGGGSGGGGSGGGGSGGGGS/RNL
PVATPDPGMFPCLHHSQNLLRAVSNMLQKARQTLEFYPCTSEEIDHEDITKDKTSTVEACLPLELTKNESCLNSRETSFITNGSCL
ASRKTSFMMALCLSSIYEDLKMYQVEFKTMNAKLLMDPKRQIFLDQNMLAVIDELMQALNFNSETVPQKSSLEEPDFYKTKIKL
CILLHAFRIRAVTIDRVMSYLNAS/GGGGSGGGGS/EPKSSDKTHTCPPCPAPPVAGPSVFLFPPKPKDTLMISRTPEVTCVVVDV
KHEDPEVKFNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFSCSVMHEAL
HNHYTQKSLSLSPGK

Figure 51

>XENP31290 human_IL12p40(E59K/K99E)_(GGGGS)5-human_IL12p35_(GGGGS)2_(single-chain)-empty-Fc_Fc(216)_IgG1_pI(-)_Isosteric_A_C220S/PVA_/S267K/L368D/K370S-Fc(216)_IgG1_C220S/PVA_/S267K/S364K/E357Q Chain 1 - human_IL12p40(E59K/K99E)_(GGGGS)5-human_IL12p35_(GGGGS)2_(single-chain)_Fc(216)_IgG1_pI(-)_Isosteric_A_C220S/PVA_/S267K/L368D/K370S (SEQ ID NO:424)
IWELKKDVYVVELDWYPDAPGEMVVLTCDTPEEDGITWTLDQSSEVLGSGKTLTIQVKKFGDAGQYTCHKGGEVLSHSLLLH
KKEDGIWSTDILKDQEEPKNKTFLRCEAKNYSGRFTCWWLTTISTDLTFSVKSSRGSSDPQGVTCGAATLSAERVRGDNKEYEYS
VECQEDSACPAAEESLPIEVMVDAVHKLKYENYTSSFFIRDIIKPDPPKNLQLKPLKNSRQVEVSWEYPDTWSTPHSYFSLTFCVQ
VQGKSREKKDRVFTDKTSATVICRKNASISVRAQDRYYSSSWSEWASVPCS/GGGGSGGGGSGGGGSGGGGSGGGGS/RNL
PVATPDPGMFPCLHHSQNLLRAVSNMLQKARQTLEFYPCTSEEIDHEDITKDKTSTVEACLPLELTKNESCLNSRETSFITNGSCL
ASRKTSFMMALCLSSIYEDLKMYQVEFKTMNAKLLMDPKRQIFLDQNMLAVIDELMQALNFNSETVPQKSSLEEPDFYKTKIKL
CILLHAFRIRAVTIDRVMSYLNAS/GGGGSGGGGS/EPKSSDKTHTCPPCPAPPVAGPSVFLFPPKPKDTLMISRTPEVTCVVVDV
KHEDPEVKFNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFSCSVMHEAL
HNHYTQKSLSLSPGK (SEQ ID NO: 424)

Chain 2 - empty-Fc(216)_IgG1_C220S/PVA_/S267K/S364K/E357Q (SEQ ID NO:467)
EPKSSDKTHTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYPSDIAVEWES
NGQPENNYKTTPPVLDSDGSFFLYSKLTVDKSRWQQGNVFSCSVMHEALHNHYTQKSLSLSPGK

Figure 53

| XENP | Format | IL-12p40 Variant | IL-12p30 Variant | pSTAT4 EC50 (µg/ml) | |
|---|---|---|---|---|---|
| | | | | CD4+ CD45RA+ CD25+ | CD8+ CD45RA+ CD25+ |
| 27201 | IL-12-heteroFc | WT | WT | 0.2535 | 0.3516 |
| 27203 | scIL-12(p40/p35)-Fc | WT | WT | 0.1205 | 0.1743 |
| 31289 | (scIL-12(P40/P35))2-Fc | WT | WT | 0.3151 | 0.4397 |
| 31290 | scIL-12(p40/p35)-Fc | E59K/K99E | WT | 8.005 | 9.459 |
| 31291 | (scIL-12(P40/P35))2-Fc | E59K/K99E | WT | 4.241 | 5.549 |

Figure 54

> XENP016432 Nivolumab_H0L0_IgG1_PVA_/S267K

XENP016432 Nivolumab_H0L0_IgG1_PVA_/S267K Heavy Chain (SEQ ID NO:355)
QVQLVESGGGVVQPGRSLRLDCKASGITFSNSGMHWVRQAPGKGLEWVAVIWYDGSKRYYADSVKGRFTISRDNS
KNTLFLQMNSLRAEDTAVYYCATNDDYWGQGTLVTVSS/ASTKGPSVFPLAPSSKSTSGGTAALGCLVKDYFPEP
VTVSWNSGALTSGVHTFPAVLQSSGLYSLSSVVTVPSSSLGTQTYICNVNHKPSNTKVDKKVEPKSCDKTHTCPP
CPAPPVAGPSVFLFPPKPKDTLMISRTPEVTCVVVDVKHEDPEVKFNWYVDGVEVHNAKTKPREEQYNSTYRVVS
VLTVLHQDWLNGKEYKCKVSNKALPAPIEKTISKAKGQPREPQVYTLPPSREEMTKNQVSLTCLVKGFYPSDIAV
EWESNGQPENNYKTTPPVLDSDGSFFLYSKLTVDKSRWQQGNVFSCSVMHEALHNHYTQKSLSLSPGK XENP016432 Nivolumab_H0L0_IgG1_PVA_/S267K Light Chain (SEQ ID NO:356)
EIVLTQSPATLSLSPGERATLSCRASQSVSSYLAWYQQKPGQAPRLLIYDASNRATGIPARFSGSGSGTDFTLTI
SSLEPEDFAVYYCQQSSNWPRTFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC > XENP021461 Pembrolizumab_H0L0_IgG4_S228P XENP021461 Pembrolizumab_H0L0_IgG4_S228P Heavy Chain (SEQ ID NO:864)
QVQLVQSGVEVKKPGASVKVSCKASGYTFTNYYMYWVRQAPGQGLEWMGGINPSNGGTNFNEKFKNRVTLTTDSS
TTTAYMELKSLQFDDTAVYYCARRDYRFDMGFDYWGQGTTVTVSS/ASTKGPSVFPLAPCSRSTSESTAALGCLV
KDYFPEPVTVSWNSGALTSGVHTFPAVLQSSGLYSLSSVVTVPSSSLGTKTYTCNVDHKPSNTKVDKRVESKYGP
PCPPCPAPEFLGGPSVFLFPPKPKDTLMISRTPEVTCVVVDVSQEDPEVQFNWYVDGVEVHNAKTKPREEQFNST
YRVVSVLTVLHQDWLNGKEYKCKVSNKGLPSSIEKTISKAKGQPREPQVYTLPPSQEEMTKNQVSLTCLVKGFYP
SDIAVEWESNGQPENNYKTTPPVLDSDGSFFLYSRLTVDKSRWQEGNVFSCSVMHEALHNHYTQKSLSLSLGK XENP021461 Pembrolizumab_H0L0_IgG4_S228P Light Chain (SEQ ID NO:865)
EIVLTQSPATLSLSPGERATLSCRASKGVSTSGYSYLHWYQQKPGQAPRLLIYLASYLESGVPARFSGSGSGTDF
TLTISSLEPEDFAVYYCQHSRDLPLTFGGGTKVEIK/RTVAAPSVFIFPPSDEQLKSGTASVVCLLNNFYPREAK
VQWKVDNALQSGNSQESVTEQDSKDSTYSLSSTLTLSKADYEKHKVYACEVTHQGLSSPVTKSFNRGEC Figure 60A
Figure 60B
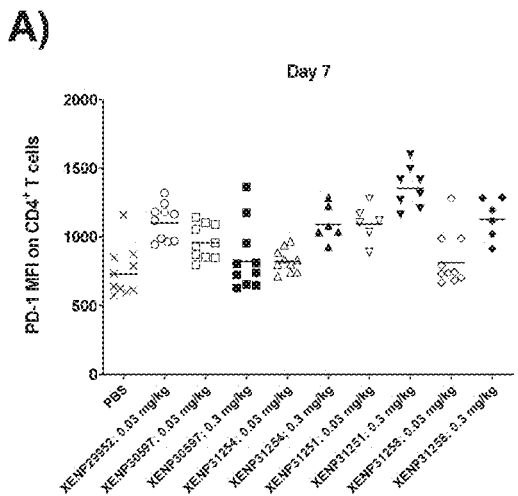
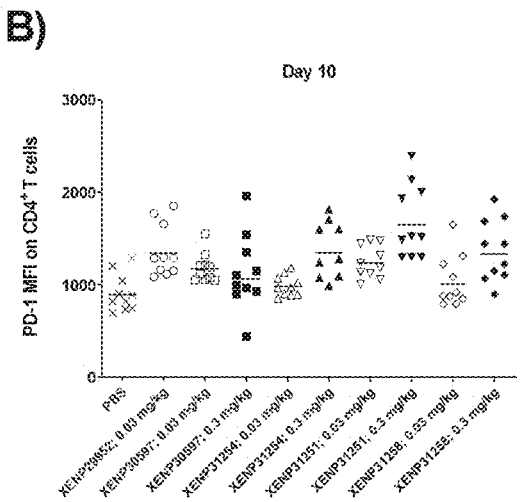
Figure 60C
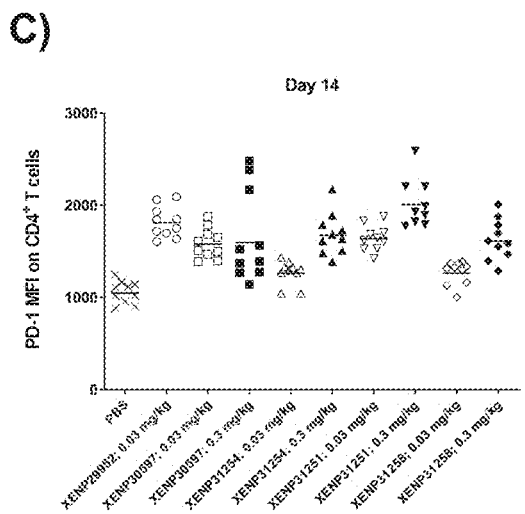

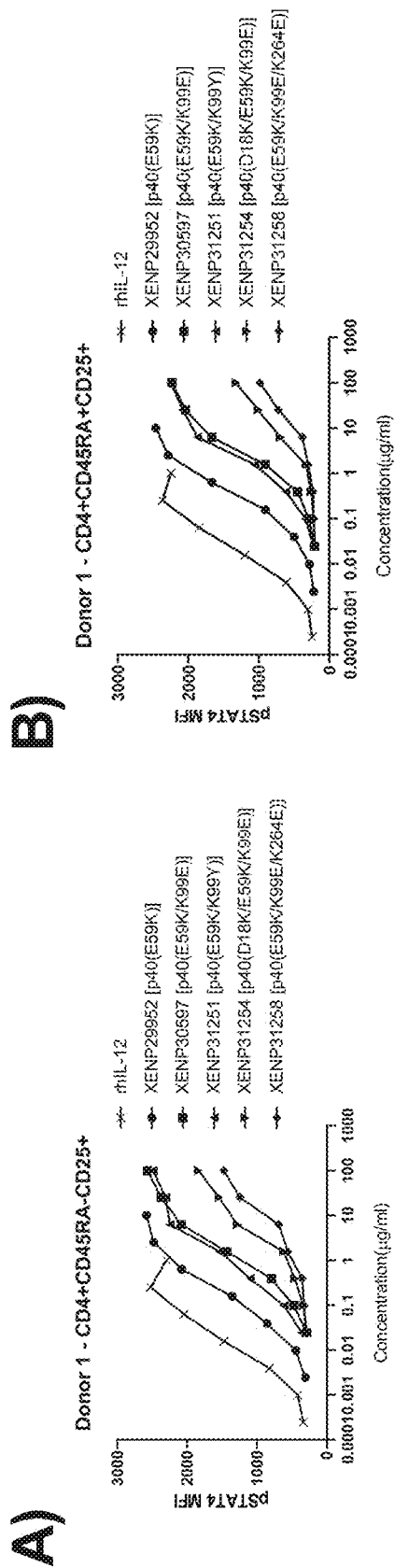
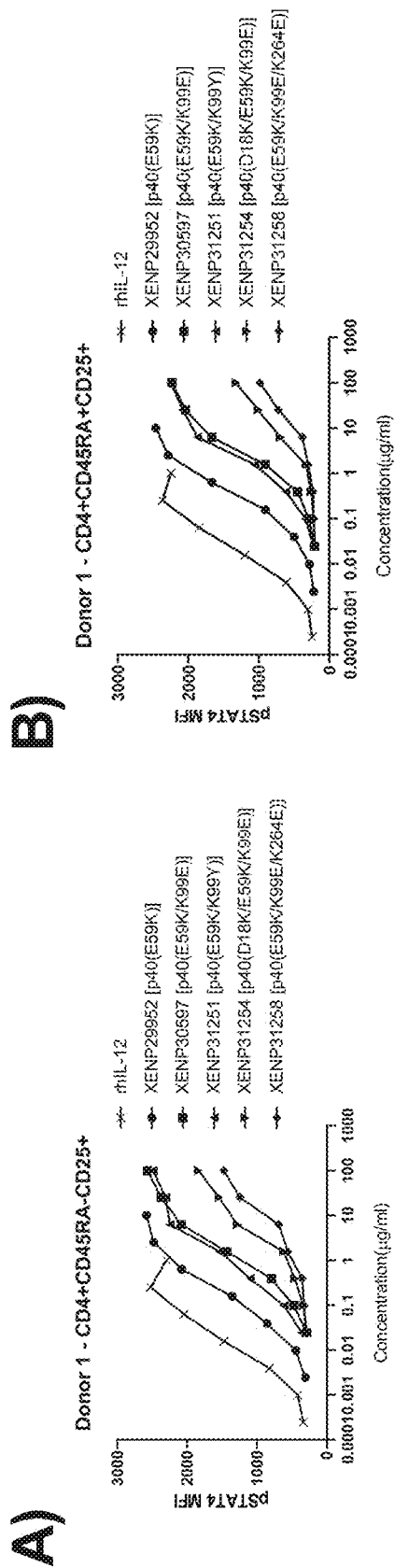
Figure 62A
Figure 62B

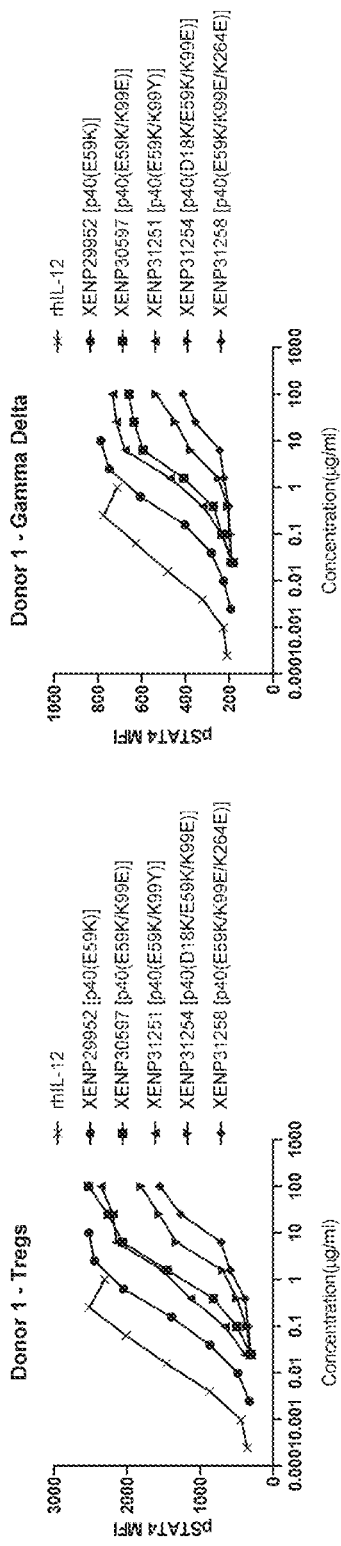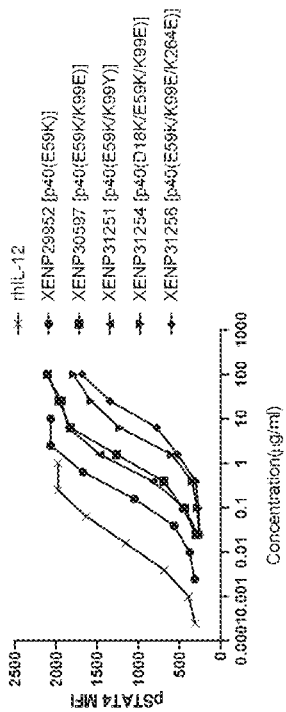

Figure 65A

>XENP31582 human_IL12p40(D18K/E59K/K99E)_(GGGGS)2-human_IL12p35_(GGGGS)2-Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S Chain 1 - human_IL12p40(D18K/E59K/K99E)_(GGGGS)2_Fc(216)_IgG1_pI(-)_Isosteric_A_C220S/PVA_/S267K/L368D/K370S/M428L/N434S (SEQ ID NO:357)

IWELKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVLHEALHSHYTQKSLSLSPGK

Chain 2 - human_IL12p35_(GGGGS)2_Fc(216)_IgG1_C220S/PVA_/S267K/S364K/E357Q/M428L/N434S (SEQ ID NO:421)

RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREMTKNQVKLTCLVKGFYPSDIAVEWE
SNGQPENNYKTTPPVLDSDGSFFLYSKLTVDKSRWQQGNVFSCSVLHEALHSHYTQKSLSLSPGK

>XENP31583 human_IL12p40(E59K/K99Y)_(GGGGS)2-human_IL12p35_(GGGGS)2-Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S Chain 1 - human_IL12p40(E59K/K99Y)_(GGGGS)2_Fc(216)_IgG1_pI(-)_Isosteric_A_C220S/PVA_/S267K/L368D/K370S/M428L/N434S (SEQ ID NO:358)

IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQYEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVLHEALHSHYTQKSLSLSPGK

Chain 2 - human_IL12p35_(GGGGS)2_Fc(216)_IgG1_C220S/PVA_/S267K/S364K/E357Q/M428L/N434S (SEQ ID NO:422)
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREMTKNQVKLTCLVKGFYPSDIAVEWE
SNGQPENNYKTTPPVLDSDGSFFLYSKLTVDKSRWQQGNVFSCSVLHEALHSHYTQKSLSLSPGK

Figure 65B

>XENP31584 human_IL12p40(E59K/K99E/K264E)_(GGGGS)2-human_IL12p35_(GGGGS)2-Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S Chain 1 - human_IL12p40(E59K/K99E/K264E)_(GGGGS)2_Fc(216)_IgG1_pI(-)_Isosteric_A_C220S/PVA_/S267K/L368D/K370S/M428L/N434S (SEQ ID NO:359)
IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKEDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVLHEALHSHYTQKSLSLSPGK Chain 2 - human_IL12p35_(GGGGS)2_Fc(216)_IgG1_C220S/PVA_/S267K/S364K/E357Q/M428L/N434S (SEQ ID NO:423)
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVLHEALHSHYTQKSLSLSPGK

Figure 66A

> IL-12p40(C252S) (SEQ ID NO:360)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS

> IL-12p40(D18K/E59K/K99E/C252S) (SEQ ID NO:361)
IWELKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS

> IL-12p40(D18K/E59K/K99E/C252S/K264E) (SEQ ID NO:362)
IWELKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS

> IL-12p40(E59K/K99Y/C252S) (SEQ ID NO:363)
IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQYEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS

> IL-12p40(E59K/K99E/C252S/K264E) (SEQ ID NO:364)
IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS

> IL-12p40(E59K/K99E/C252S) (SEQ ID NO:365)
IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS

>IL-12p40(E59K/K99E/N103Q/C252S/K264E) (SEQ ID NO:366)
IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKQKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS

>IL-12p40(E59K/K99E/N113Q/C252S/K264E) (SEQ ID NO:367)
IWELKKDVYVVELDWYPDAPGEMVVLTCDTPEEDGITWTLDQSSEVLGSGKTLTIQVKKFGDAGQYTCHKGGEVLSHSL
LLLHKKEDGIWSTDILKDQEEPKNKTFLRCEAKQYSGRFTCWWLTTISTDLTFSVKSSRGSSDPQGVTCGAATLSAERV
RGDNKEYEYSVECQEDSACPAAEESLPIEVMVDAVHKLKYENYTSSFFIRDIIKPDPPKNLQLKPLKNSRQVEVSWEYP
DTWSTPHSYFSLTFSVQVQGKSKREKEDRVFTDKTSATVICRKNASISVRAQDRYYSSSWSEWASVPCS

Figure 66B

\>IL-12p40(E59K/K99E/N200Q/C252S/K264E) (SEQ ID NO:368)
IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS

\>IL-12p40(E59K/K99E/N281Q/C252S/K264E) (SEQ ID NO:369)
IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKEDRVFTDKTSATVICRKQASISVRAQDRYYSSSWSEW
ASVPCS

\>IL-12p40(E59K/K99E/N103Q/N113Q/C252S/K264E) (SEQ ID NO:370)
IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKQKTFLRCEAKQYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS

\>IL-12p40(E59K/K99E/N103Q/N200Q/C252S/K264E) (SEQ ID NO:371)
IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKQKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS

\>IL-12p40(E59K/K99E/N103Q/N281Q/C252S/K264E) (SEQ ID NO:372)
IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKQKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKEDRVFTDKTSATVICRKQASISVRAQDRYYSSSWSEW
ASVPCS

\>IL-12p40(E59K/K99E/N113Q/N200Q/C252S/K264E) (SEQ ID NO:373)
IWELKKDVYVVELDWYPDAPGEMVVLTCDTPEEDGITWTLDQSSEVLGSGKTLTIQVKKFGDAGQYTCHKGGEVLSHSL
LLLHKKEDGIWSTDILKDQEEPKNKTFLRCEAKQYSGRFTCWWLTTISTDLTFSVKSSRGSSDPQGVTCGAATLSAERV
RGDNKEYEYSVECQEDSACPAAEESLPIEVMVDAVHKLKYEQYTSSFFIRDIIKPDPPKNLQLKPLKNSRQVEVSWEYP
DTWSTPHSYFSLTFSVQVQGKSKREKEDRVFTDKTSATVICRKNASISVRAQDRYYSSSWSEWASVPCS

\>IL-12p40(E59K/K99E/N113Q/N281Q/C252S/K264E) (SEQ ID NO:374)
IWELKKDVYVVELDWYPDAPGEMVVLTCDTPEEDGITWTLDQSSEVLGSGKTLTIQVKKFGDAGQYTCHKGGEVLSHSL
LLLHKKEDGIWSTDILKDQEEPKNKTFLRCEAKQYSGRFTCWWLTTISTDLTFSVKSSRGSSDPQGVTCGAATLSAERV
RGDNKEYEYSVECQEDSACPAAEESLPIEVMVDAVHKLKYENYTSSFFIRDIIKPDPPKNLQLKPLKNSRQVEVSWEYP
DTWSTPHSYFSLTFSVQVQGKSKREKEDRVFTDKTSATVICRKQASISVRAQDRYYSSSWSEWASVPCS

\>IL-12p40(E59K/K99E/N200Q/N281Q/C252S/K264E) (SEQ ID NO:375)
IWELKKDVYVVELDWYPDAPGEMVVLTCDTPEEDGITWTLDQSSEVLGSGKTLTIQVKKFGDAGQYTCHKGGEVLSHSL
LLLHKKEDGIWSTDILKDQEEPKNKTFLRCEAKNYSGRFTCWWLTTISTDLTFSVKSSRGSSDPQGVTCGAATLSAERV
RGDNKEYEYSVECQEDSACPAAEESLPIEVMVDAVHKLKYEQYTSSFFIRDIIKPDPPKNLQLKPLKNSRQVEVSWEYP
DTWSTPHSYFSLTFSVQVQGKSKREKEDRVFTDKTSATVICRKQASISVRAQDRYYSSSWSEWASVPCS

Figure 66C

>IL-12p40(E59K/K99E/N103Q/N113Q/N200Q/C252S/K264E) (SEQ ID NO:376)
IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKQKTFLRCEAKQYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS

>IL-12p40(E59K/K99E/N103Q/N200Q/N281Q/C252S/K264E) (SEQ ID NO:377)
IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKQKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKEDRVFTDKTSATVICRKQASISVRAQDRYYSSSWSEW
ASVPCS

>IL-12p40(E59K/K99E/N113Q/N200Q/N281Q/C252S/K264E) (SEQ ID NO:378)
IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKQYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKEDRVFTDKTSATVICRKQASISVRAQDRYYSSSWSEW
ASVPCS

>IL-12p40(E59K/K99E/N103Q/N113Q/N200Q/N281Q/C252S/K264E) (SEQ ID NO:379)
IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKQKTFLRCEAKQYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKEDRVFTDKTSATVICRKQASISVRAQDRYYSSSWSEW
ASVPCS

Figure 67A

>XENP32187 human_IL12p40(D18K/E59K/K99E/C252S)_(GGGGS)2-human_IL12p35_(GGGGS)2-
Fc(216)_IgG1_pl(-
)_Isosteric_A_C220S/PVA_/S267K/L368D/K370S_Fc(216)_IgG1_C220S/PVA_/S267K/S364K/E357Q Chain 1 - human_IL12p40(D18K/E59K/K99E/C252S)_(GGGGS)2_Fc(216)_IgG1_pl(-
)_Isosteric_A_C220S/PVA_/S267K/L368D/K370S (SEQ ID NO:380)
*IWELKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/*GGGGSGGGGS/*EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK*

Chain 2 - IL12p35_(GGGGS)2_Fc(216)_IgG1_C220S/PVA_/S267K/S364K/E357Q (SEQ ID NO:402)
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/*GGGGSGGGGS/*EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK*

>XENP32188 human_IL12p40(D18K/E59K/K99E/C252S/K264E)_(GGGGS)2-human_IL12p35_(GGGGS)2-
Fc(216)_IgG1_pl(-
)_Isosteric_A_C220S/PVA_/S267K/L368D/K370S_Fc(216)_IgG1_C220S/PVA_/S267K/S364K/E357Q Chain 1 - human_IL12p40(D18K/E59K/K99E/C252S/K264E)_(GGGGS)2_Fc(216)_IgG1_pl(-
)_Isosteric_A_C220S/PVA_/S267K/L368D/K370S (SEQ ID NO:381)
*IWELKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS/*GGGGSGGGGS/*EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK*

Chain 2 - IL12p35_(GGGGS)2_Fc(216)_IgG1_C220S/PVA_/S267K/S364K/E357Q (SEQ ID NO:403)
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/*GGGGSGGGGS/*EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK*

Figure 67B

>XENP32189 human_IL12p40(E59K/K99Y/C252S)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 - human_IL12p40(E59K/K99Y/C252S)_(GGGGS)2_Fc(216)_IgG1_pI(-)_Isosteric_A_C220S/PVA_/S267K/L368D/K370S  (SEQ ID NO:382)
*IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQYEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/<u>GGGGSGGGGS</u>/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK*

Chain 2 - IL12p35_(GGGGS)2_Fc(216)_IgG1_C220S/PVA_/S267K/S364K/E357Q  (SEQ ID NO:404)
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/<u>GGGGSGGGGS</u>/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK*

>XENP32190 human_IL12p40(E59K/K99E/C252S/K264E)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 - human_IL12p40(E59K/K99E/C252S/K264E)_(GGGGS)2_Fc(216)_IgG1_pI(-)_Isosteric_A_C220S/PVA_/S267K/L368D/K370S  (SEQ ID NO:425)
*IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS/<u>GGGGSGGGGS</u>/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK*

Chain 2 - IL12p35_(GGGGS)2_Fc(216)_IgG1_C220S/PVA_/S267K/S364K/E357Q  (SEQ ID NO:405)
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/<u>GGGGSGGGGS</u>/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK*

Figure 67C

>XENP32191 human_IL12p40(E59K/K99E/C252S)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 - human_IL12p40(E59K/K99E/C252S)_(GGGGS)2_Fc(216)_IgG1_pI(-)_Isosteric_A_C220S/PVA_/S267K/L368D/K370S (SEQ ID NO:384)

*IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/<u>GGGGSGGGGS</u>/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK*

Chain 2 - IL12p35_(GGGGS)2_Fc(216)_IgG1_C220S/PVA_/S267K/S364K/E357Q (SEQ ID NO:406)

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/<u>GGGGSGGGGS</u>/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK*

>XENP32991 human_IL12p40_E59K/K99E/N103Q/C252S/K264E_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 - IL-12p35_(E59K/K99E/N103Q/C252S/K264E_(GGGGS)2_Fc(216)_IgG1_pI(-)_Isosteric_A_C220S/PVA_/S267K/L368D/K370S (SEQ ID NO:385)

*IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKQKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS/<u>GGGGSGGGGS</u>/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK*

Chain 2 - human_IL12p35_(GGGGS)2_Fc(216)_IgG1_C220S/PVA_/S267K/S364K/E357Q (SEQ ID NO:407)

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/<u>GGGGSGGGGS</u>/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK*

Figure 67D

>XENP32992 human_IL12p40_E59K/K99E/N113Q/C252S/K264E_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 - IL-12p40(E59K/K99E/N113Q/C252S/K264E_(GGGGS)2_Fc(216)_IgG1_pI(-
)_Isosteric_A_C220S/PVA_/S267K/L368D/K370S (SEQ ID NO:386)
*IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKQYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS/*<u>GGGGSGGGGS</u>*/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK*

Chain 2 - human_IL12p35_(GGGGS)2_Fc(216)_IgG1_C220S/PVA_/S267K/S364K/E357Q (SEQ ID NO:408)
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/*<u>GGGGSGGGGS</u>*/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK*

>XENP32993 human_IL12p40_E59K/K99E/N200Q/C252S/K264E_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 - IL-12p40(E59K/K99E/N200Q/C252S/K264E_(GGGGS)2_Fc(216)_IgG1_pI(-
)_Isosteric_A_C220S/PVA_/S267K/L368D/K370S (SEQ ID NO:387)
*IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS/*<u>GGGGSGGGGS</u>*/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK*

Figure 67E

Chain 2 - human_IL12p35_(GGGGS)2_Fc(216)_IgG1_C220S/PVA_/S267K/S364K/E357Q (SEQ ID NO:409)

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/<u>GGGGSGGGGS</u>/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK*

<u>**>XENP32994 human_IL12p40_E59K/K99E/N281Q/C252S/K264E_(GGGGS)2-human_IL12p35_(GGGGS)2-
Fc(216)_IgG1_pI(-
)_Isosteric_A_C220S/PVA_/S267K/L368D/K370S_Fc(216)_IgG1_C220S/PVA_/S267K/S364K/E357Q**</u>

**Chain 1 - IL-12p40(E59K/K99E/N281Q/C252S/K264E_(GGGGS)2_Fc(216)_IgG1_pI(-
)_Isosteric_A_C220S/PVA_/S267K/L368D/K370S (SEQ ID NO:388)**

*IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKEDRVFTDKTSATVICRKQASISVRAQDRYYSSSWSEW
ASVPCS/<u>GGGGSGGGGS</u>/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK*

Chain 2 - human_IL12p35_(GGGGS)2_Fc(216)_IgG1_C220S/PVA_/S267K/S364K/E357Q (SEQ ID NO:410)

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/<u>GGGGSGGGGS</u>/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK*

Figure 67F

>XENP32995 human_IL12p40_E59K/K99E/N103Q/N113Q/C252S/K264E_(GGGGS)2-
human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 - IL-12p40(E59K/K99E/N103Q/N113Q/C252S/K264E_(GGGGS)2_Fc(216)_IgG1_pI(-
)_Isosteric_A_C220S/PVA_/S267K/L368D/K370S (SEQ ID NO:389)
IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKQKTFLRCEAKQYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK Chain 2 - human_IL12p35_(GGGGS)2_Fc(216)_IgG1_C220S/PVA_/S267K/S364K/E357Q (SEQ ID NO:411)
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK >XENP32996 human_IL12p40_E59K/K99E/N103Q/N200Q/C252S/K264E_(GGGGS)2-
human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 - IL-12p40(E59K/K99E/N103Q/N200Q/C252S/K264E_(GGGGS)2_Fc(216)_IgG1_pI(-
)_Isosteric_A_C220S/PVA_/S267K/L368D/K370S (SEQ ID NO:390)
IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKQKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK Chain 2 - human_IL12p35_(GGGGS)2_Fc(216)_IgG1_C220S/PVA_/S267K/S364K/E357Q (SEQ ID NO:412)
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK

Figure 67G

>XENP32997 human_IL12p40_E59K/K99E/N103Q/N281Q/C252S/K264E_(GGGGS)2-
human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q

**Chain 1 - IL-12p40(E59K/K99E/N103Q/N281Q/C252S/K264E_(GGGGS)2_Fc(216)_IgG1_pI(-
)_Isosteric_A_C220S/PVA_/S267K/L368D/K370S (SEQ ID NO:391)**
*IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKQKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKEDRVFTDKTSATVICRKQASISVRAQDRYYSSSWSEW
ASVPCS/*<u>GGGGSGGGGS</u>*/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK*

Chain 2 - human_IL12p35_(GGGGS)2_Fc(216)_IgG1_C220S/PVA_/S267K/S364K/E357Q (SEQ ID NO:413)
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/*<u>GGGGSGGGGS</u>*/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK*

>XENP32998 human_IL12p40_E59K/K99E/N113Q/N200Q/C252S/K264E_(GGGGS)2-
human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q

**Chain 1 - IL-12p40(E59K/K99E/N113Q/N200Q/C252S/K264E_(GGGGS)2_Fc(216)_IgG1_pI(-
)_Isosteric_A_C220S/PVA_/S267K/L368D/K370S (SEQ ID NO:392)**
*IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKQYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS/*<u>GGGGSGGGGS</u>*/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK*

Chain 2 - human_IL12p35_(GGGGS)2_Fc(216)_IgG1_C220S/PVA_/S267K/S364K/E357Q (SEQ ID NO:414)
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/*<u>GGGGSGGGGS</u>*/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK*

Figure 67H

\>XENP32999 human_IL12p40_E59K/K99E/N113Q/N281Q/C252S/K264E_(GGGGS)2-
human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 - IL-12p40(E59K/K99E/N113Q/N281Q/C252S/K264E_(GGGGS)2_Fc(216)_IgG1_pI(-
)_Isosteric_A_C220S/PVA_/S267K/L368D/K370S (SEQ ID NO:393)
*IWELKKDVYVVELDWYPDAPGEMVVLTCDTPEEDGITWTLDQSSEVLGSGKTLTIQVKKFGDAGQYTCHKGGEVL*
*SHSLLLLHKKEDGIWSTDILKDQEEPKNKTFLRCEAKQYSGRFTCWWLTTISTDLTFSVKSSRGSSDPQGVTCGA*
*ATLSAERVRGDNKEYEYSVECQEDSACPAAEESLPIEVMVDAVHKLKYENYTSSFFIRDIIKPDPPKNLQLKPLK*
*NSRQVEVSWEYPDTWSTPHSYFSLTFSVQVQGKSKREKEDRVFTDKTSATVICRKQASISVRAQDRYYSSSWSEW*
*ASVPCS/*GGGGSGGGGS*/EPKSSDKTHTCPPCPAPPVAGPSVFLFPPKPKDTLMISRTPEVTCVVVDVKHEDPEV*
*KFNWYVDGVEVHNAKTKPREEEYNSTYRVVSVLTVLHQDWLNGKEYKCKVSNKALPAPIEKTISKAKGQPREPQV*
*YTLPPSREEMTKNQVSLTCDVSGFYPSDIAVEWESDGQPENNYKTTPPVLDSDGSFFLYSKLTVDKSRWEQGDVF*
*SCSVMHEALHNHYTQKSLSLSPGK*

Chain 2 - human_IL12p35_(GGGGS)2_Fc(216)_IgG1_C220S/PVA_/S267K/S364K/E357Q (SEQ ID NO:415)
*RNLPVATPDPGMFPCLHHSQNLLRAVSNMLQKARQTLEFYPCTSEEIDHEDITKDKTSTVEACLPLELTKNESCL*
*NSRETSFITNGSCLASRKTSFMMALCLSSIYEDLKMYQVEFKTMNAKLLMDPKRQIFLDQNMLAVIDELMQALNF*
*NSETVPQKSSLEEPDFYKTKIKLCILLHAFRIRAVTIDRVMSYLNAS/*GGGGSGGGGS*/EPKSSDKTHTCPPCPA*
*PPVAGPSVFLFPPKPKDTLMISRTPEVTCVVVDVKHEDPEVKFNWYVDGVEVHNAKTKPREEQYNSTYRVVSVLT*
*VLHQDWLNGKEYKCKVSNKALPAPIEKTISKAKGQPREPQVYTLPPSREQMTKNQVKLTCLVKGFYPSDIAVEWE*
*SNGQPENNYKTTPPVLDSDGSFFLYSKLTVDKSRWQQGNVFSCSVMHEALHNHYTQKSLSLSPGK*

\>XENP33000 human_IL12p40_E59K/K99E/N200Q/N281Q/C252S/K264E_(GGGGS)2-
human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 - IL-12p40(E59K/K99E/N200Q/N281Q/C252S/K264E_(GGGGS)2_Fc(216)_IgG1_pI(-
)_Isosteric_A_C220S/PVA_/S267K/L368D/K370S (SEQ ID NO:394)
*IWELKKDVYVVELDWYPDAPGEMVVLTCDTPEEDGITWTLDQSSEVLGSGKTLTIQVKKFGDAGQYTCHKGGEVL*
*SHSLLLLHKKEDGIWSTDILKDQEEPKNKTFLRCEAKNYSGRFTCWWLTTISTDLTFSVKSSRGSSDPQGVTCGA*
*ATLSAERVRGDNKEYEYSVECQEDSACPAAEESLPIEVMVDAVHKLKYEQYTSSFFIRDIIKPDPPKNLQLKPLK*
*NSRQVEVSWEYPDTWSTPHSYFSLTFSVQVQGKSKREKEDRVFTDKTSATVICRKQASISVRAQDRYYSSSWSEW*
*ASVPCS/*GGGGSGGGGS*/EPKSSDKTHTCPPCPAPPVAGPSVFLFPPKPKDTLMISRTPEVTCVVVDVKHEDPEV*
*KFNWYVDGVEVHNAKTKPREEEYNSTYRVVSVLTVLHQDWLNGKEYKCKVSNKALPAPIEKTISKAKGQPREPQV*
*YTLPPSREEMTKNQVSLTCDVSGFYPSDIAVEWESDGQPENNYKTTPPVLDSDGSFFLYSKLTVDKSRWEQGDVF*
*SCSVMHEALHNHYTQKSLSLSPGK*

Chain 2 - human_IL12p35_(GGGGS)2_Fc(216)_IgG1_C220S/PVA_/S267K/S364K/E357Q (SEQ ID NO:416)
*RNLPVATPDPGMFPCLHHSQNLLRAVSNMLQKARQTLEFYPCTSEEIDHEDITKDKTSTVEACLPLELTKNESCL*
*NSRETSFITNGSCLASRKTSFMMALCLSSIYEDLKMYQVEFKTMNAKLLMDPKRQIFLDQNMLAVIDELMQALNF*
*NSETVPQKSSLEEPDFYKTKIKLCILLHAFRIRAVTIDRVMSYLNAS/*GGGGSGGGGS*/EPKSSDKTHTCPPCPA*
*PPVAGPSVFLFPPKPKDTLMISRTPEVTCVVVDVKHEDPEVKFNWYVDGVEVHNAKTKPREEQYNSTYRVVSVLT*
*VLHQDWLNGKEYKCKVSNKALPAPIEKTISKAKGQPREPQVYTLPPSREQMTKNQVKLTCLVKGFYPSDIAVEWE*
*SNGQPENNYKTTPPVLDSDGSFFLYSKLTVDKSRWQQGNVFSCSVMHEALHNHYTQKSLSLSPGK*

Figure 67I

>XENP33001 human_IL12p40_E59K/K99E/N103Q/N113Q/N200Q/C252S/K264E_(GGGGS)2-
human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 - IL-12p40(E59K/K99E/N103Q/N113Q/N200Q/C252S/K264E_(GGGGS)2_Fc(216)_IgG1_pI(-
)_Isosteric_A_C220S/PVA_/S267K/L368D/K370S (SEQ ID NO:395)
*IWELKKDVYVVELDWYPDAPGEMVVLTCDTPEEDGITWTLDQSSEVLGSGKTLTIQVKKFGDAGQYTCHKGGEVL*
*SHSLLLLHKKEDGIWSTDILKDQEEPKQKTFLRCEAKQYSGRFTCWWLTTISTDLTFSVKSSRGSSDPQGVTCGA*
*ATLSAERVRGDNKEYEYSVECQEDSACPAAEESLPIEVMVDAVHKLKYEQYTSSFFIRDIIKPDPPKNLQLKPLK*
*NSRQVEVSWEYPDTWSTPHSYFSLTFSVQVQGKSKREKEDRVFTDKTSATVICRKNASISVRAQDRYYSSSWSEW*
*ASVPCS/GGGGSGGGGS/EPKSSDKTHTCPPCPAPPVAGPSVFLFPPKPKDTLMISRTPEVTCVVVDVKHEDPEV*
*KFNWYVDGVEVHNAKTKPREEEYNSTYRVVSVLTVLHQDWLNGKEYKCKVSNKALPAPIEKTISKAKGQPREPQV*
*YTLPPSREEMTKNQVSLTCDVSGFYPSDIAVEWESDGQPENNYKTTPPVLDSDGSFFLYSKLTVDKSRWEQGDVF*
*SCSVMHEALHNHYTQKSLSLSPGK*

Chain 2 - human_IL12p35_(GGGGS)2_Fc(216)_IgG1_C220S/PVA_/S267K/S364K/E357Q (SEQ ID NO:417)
*RNLPVATPDPGMFPCLHHSQNLLRAVSNMLQKARQTLEFYPCTSEEIDHEDITKDKTSTVEACLPLELTKNESCL*
*NSRETSFITNGSCLASRKTSFMMALCLSSIYEDLKMYQVEFKTMNAKLLMDPKRQIFLDQNMLAVIDELMQALNF*
*NSETVPQKSSLEEPDFYKTKIKLCILLHAFRIRAVTIDRVMSYLNAS/GGGGSGGGGS/EPKSSDKTHTCPPCPA*
*PPVAGPSVFLFPPKPKDTLMISRTPEVTCVVVDVKHEDPEVKFNWYVDGVEVHNAKTKPREEQYNSTYRVVSVLT*
*VLHQDWLNGKEYKCKVSNKALPAPIEKTISKAKGQPREPQVYTLPPSREQMTKNQVKLTCLVKGFYPSDIAVEWE*
*SNGQPENNYKTTPPVLDSDGSFFLYSKLTVDKSRWQQGNVFSCSVMHEALHNHYTQKSLSLSPGK*

>XENP33002 human_IL12p40_E59K/K99E/N103Q/N200Q/N281Q/C252S/K264E_(GGGGS)2-
human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 - IL-12p40(E59K/K99E/N103Q/N200Q/N281Q/C252S/K264E_(GGGGS)2_Fc(216)_IgG1_pI(-
)_Isosteric_A_C220S/PVA_/S267K/L368D/K370S (SEQ ID NO:396)
*IWELKKDVYVVELDWYPDAPGEMVVLTCDTPEEDGITWTLDQSSEVLGSGKTLTIQVKKFGDAGQYTCHKGGEVL*
*SHSLLLLHKKEDGIWSTDILKDQEEPKQKTFLRCEAKNYSGRFTCWWLTTISTDLTFSVKSSRGSSDPQGVTCGA*
*ATLSAERVRGDNKEYEYSVECQEDSACPAAEESLPIEVMVDAVHKLKYEQYTSSFFIRDIIKPDPPKNLQLKPLK*
*NSRQVEVSWEYPDTWSTPHSYFSLTFSVQVQGKSKREKEDRVFTDKTSATVICRKQASISVRAQDRYYSSSWSEW*
*ASVPCS/GGGGSGGGGS/EPKSSDKTHTCPPCPAPPVAGPSVFLFPPKPKDTLMISRTPEVTCVVVDVKHEDPEV*
*KFNWYVDGVEVHNAKTKPREEEYNSTYRVVSVLTVLHQDWLNGKEYKCKVSNKALPAPIEKTISKAKGQPREPQV*
*YTLPPSREEMTKNQVSLTCDVSGFYPSDIAVEWESDGQPENNYKTTPPVLDSDGSFFLYSKLTVDKSRWEQGDVF*
*SCSVMHEALHNHYTQKSLSLSPGK*

Chain 2 - human_IL12p35_(GGGGS)2_Fc(216)_IgG1_C220S/PVA_/S267K/S364K/E357Q (SEQ ID NO:418)
*RNLPVATPDPGMFPCLHHSQNLLRAVSNMLQKARQTLEFYPCTSEEIDHEDITKDKTSTVEACLPLELTKNESCL*
*NSRETSFITNGSCLASRKTSFMMALCLSSIYEDLKMYQVEFKTMNAKLLMDPKRQIFLDQNMLAVIDELMQALNF*
*NSETVPQKSSLEEPDFYKTKIKLCILLHAFRIRAVTIDRVMSYLNAS/GGGGSGGGGS/EPKSSDKTHTCPPCPA*
*PPVAGPSVFLFPPKPKDTLMISRTPEVTCVVVDVKHEDPEVKFNWYVDGVEVHNAKTKPREEQYNSTYRVVSVLT*
*VLHQDWLNGKEYKCKVSNKALPAPIEKTISKAKGQPREPQVYTLPPSREQMTKNQVKLTCLVKGFYPSDIAVEWE*
*SNGQPENNYKTTPPVLDSDGSFFLYSKLTVDKSRWQQGNVFSCSVMHEALHNHYTQKSLSLSPGK*

Figure 67J

>XENP33003 human_IL12p40_E59K/K99E/N113Q/N200Q/N281Q/C252S/K264E_(GGGGS)2-
human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 - IL-12p40(E59K/K99E/N113Q/N200Q/N281Q/C252S/K264E_(GGGGS)2_Fc(216)_IgG1_pI(-
)_Isosteric_A_C220S/PVA_/S267K/L368D/K370S (SEQ ID NO:397)
*IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKQYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKEDRVFTDKTSATVICRKQASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK*

Chain 2 - human_IL12p35_(GGGGS)2_Fc(216)_IgG1_C220S/PVA_/S267K/S364K/E357Q (SEQ ID NO:419)
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK*

>XENP33004 human_IL12p40_E59K/K99E/N103Q/N113Q/N200Q/N281Q/C252S/K264E_(GGGGS)2-
human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 - IL-12p40(E59K/K99E/N103Q/N113Q/N200Q/N281Q/C252S/K264E_(GGGGS)2_Fc(216)_IgG1_pI(-
)_Isosteric_A_C220S/PVA_/S267K/L368D/K370S (SEQ ID NO:398)
*IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKQKTFLRCEAKQYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKEDRVFTDKTSATVICRKQASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK*

Chain 2 - human_IL12p35_(GGGGS)2_Fc(216)_IgG1_C220S/PVA_/S267K/S364K/E357Q (SEQ ID NO:420)
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK*

Figure 67K

>XENP33005 human_IL12p40(E59K/K99E/C252S/K264E)_(GGGGS)2-human_IL12p35(N71Q)_(GGGGS)2-
Fc(216)_IgG1_pI(-
)_Isosteric_A_C220S/PVA_/S267K/L368D/K370S_Fc(216)_IgG1_C220S/PVA_/S267K/S364K/E357Q Chain 1 - human_IL12p40(E59K/K99E/C252S/K264E)_(GGGGS)2_Fc(216)_IgG1_pI(-
)_Isosteric_A_C220S/PVA_/S267K/L368D/K370S (SEQ ID NO:426)
IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK Chain 2 - human_IL12p35(N71Q)_(GGGGS)2_Fc(216)_IgG1_C220S/PVA_/S267K/S364K/E357Q (SEQ ID
NO:399)
RNLPVATPDPGMFPCLHHSQNLLRAVSNMLQKARQTLEFYPCTSEEIDHEDITKDKTSTVEACLPLELTKQESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK >XENP33006 human_IL12p40(E59K/K99E/C252S/K264E)_(GGGGS)2-human_IL12p35(N85Q)_(GGGGS)2-
Fc(216)_IgG1_pI(-
)_Isosteric_A_C220S/PVA_/S267K/L368D/K370S_Fc(216)_IgG1_C220S/PVA_/S267K/S364K/E357Q Chain 1 - human_IL12p40(E59K/K99E/C252S/K264E)_(GGGGS)2_Fc(216)_IgG1_pI(-
)_Isosteric_A_C220S/PVA_/S267K/L368D/K370S (SEQ ID NO:427)
IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK Chain 2 - human_IL12p35(N85Q)_(GGGGS)2_Fc(216)_IgG1_C220S/PVA_/S267K/S364K/E357Q (SEQ ID
NO:400)
RNLPVATPDPGMFPCLHHSQNLLRAVSNMLQKARQTLEFYPCTSEEIDHEDITKDKTSTVEACLPLELTKNESCL
NSRETSFITQGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK

Figure 67L

>XENP33007 human_IL12p40(E59K/K99E/C252S/K264E)_(GGGGS)2-human_IL12p35(N195Q)_(GGGGS)2-Fc(216)_IgG1_pl(-)_Isosteric_A_C220S/PVA_/S267K/L368D/K370S_Fc(216)_IgG1_C220S/PVA_/S267K/S364K/E357Q Chain 1 - human_IL12p40(E59K/K99E/C252S/K264E)_(GGGGS)2_Fc(216)_IgG1_pl(-)_Isosteric_A_C220S/PVA_/S267K/L368D/K370S (SEQ ID NO:428)
*IWELKKDVYVVELDWYPDAPGEMVVLTCDTPEEDGITWTLDQSSEVLGSGKTLTIQVKKFGDAGQYTCHKGGEVL*
*SHSLLLLHKKEDGIWSTDILKDQEEPKNKTFLRCEAKNYSGRFTCWWLTTISTDLTFSVKSSRGSSDPQGVTCGA*
*ATLSAERVRGDNKEYEYSVECQEDSACPAAEESLPIEVMVDAVHKLKYENYTSSFFIRDIIKPDPPKNLQLKPLK*
*NSRQVEVSWEYPDTWSTPHSYFSLTFSVQVQGKSKREKEDRVFTDKTSATVICRKNASISVRAQDRYYSSSWSEW*
*ASVPCS*/GGGGSGGGGS/*EPKSSDKTHTCPPCPAPPVAGPSVFLFPPKPKDTLMISRTPEVTCVVVDVKHEDPEV*
*KFNWYVDGVEVHNAKTKPREEEYNSTYRVVSVLTVLHQDWLNGKEYKCKVSNKALPAPIEKTISKAKGQPREPQV*
*YTLPPSREEMTKNQVSLTCDVSGFYPSDIAVEWESDGQPENNYKTTPPVLDSDGSFFLYSKLTVDKSRWEQGDVF*
*SCSVMHEALHNHYTQKSLSLSPGK*

Chain 2 - human_IL12p35(N195Q)_(GGGGS)2_Fc(216)_IgG1_C220S/PVA_/S267K/S364K/E357Q (SEQ ID NO:401)
*RNLPVATPDPGMFPCLHHSQNLLRAVSNMLQKARQTLEFYPCTSEEIDHEDITKDKTSTVEACLPLELTKNESCL*
*NSRETSFITNGSCLASRKTSFMMALCLSSIYEDLKMYQVEFKTMNAKLLMDPKRQIFLDQNMLAVIDELMQALNF*
*NSETVPQKSSLEEPDFYKTKIKLCILLHAFRIRAVTIDRVMSYLQAS*/GGGGSGGGGS/*EPKSSDKTHTCPPCPA*
*PPVAGPSVFLFPPKPKDTLMISRTPEVTCVVVDVKHEDPEVKFNWYVDGVEVHNAKTKPREEQYNSTYRVVSVLT*
*VLHQDWLNGKEYKCKVSNKALPAPIEKTISKAKGQPREPQVYTLPPSREQMTKNQVKLTCLVKGFYPSDIAVEWE*
*SNGQPENNYKTTPPVLDSDGSFFLYSKLTVDKSRWQQGNVFSCSVMHEALHNHYTQKSLSLSPGK*

>XENP33008 human_IL12p40(E59K/K99E/C252S/K264E)_(GGGGS)2-human_IL12p35(N71Q/N85Q)_(GGGGS)2-Fc(216)_IgG1_pl(-)_Isosteric_A_C220S/PVA_/S267K/L368D/K370S_Fc(216)_IgG1_C220S/PVA_/S267K/S364K/E357Q Chain 1 - human_IL12p40(E59K/K99E/C252S/K264E)_(GGGGS)2_Fc(216)_IgG1_pl(-)_Isosteric_A_C220S/PVA_/S267K/L368D/K370S (SEQ ID NO:429)
*IWELKKDVYVVELDWYPDAPGEMVVLTCDTPEEDGITWTLDQSSEVLGSGKTLTIQVKKFGDAGQYTCHKGGEVL*
*SHSLLLLHKKEDGIWSTDILKDQEEPKNKTFLRCEAKNYSGRFTCWWLTTISTDLTFSVKSSRGSSDPQGVTCGA*
*ATLSAERVRGDNKEYEYSVECQEDSACPAAEESLPIEVMVDAVHKLKYENYTSSFFIRDIIKPDPPKNLQLKPLK*
*NSRQVEVSWEYPDTWSTPHSYFSLTFSVQVQGKSKREKEDRVFTDKTSATVICRKNASISVRAQDRYYSSSWSEW*
*ASVPCS*/GGGGSGGGGS/*EPKSSDKTHTCPPCPAPPVAGPSVFLFPPKPKDTLMISRTPEVTCVVVDVKHEDPEV*
*KFNWYVDGVEVHNAKTKPREEEYNSTYRVVSVLTVLHQDWLNGKEYKCKVSNKALPAPIEKTISKAKGQPREPQV*
*YTLPPSREEMTKNQVSLTCDVSGFYPSDIAVEWESDGQPENNYKTTPPVLDSDGSFFLYSKLTVDKSRWEQGDVF*
*SCSVMHEALHNHYTQKSLSLSPGK*

Chain 2 - human_IL12p35(N71Q/N85Q)_(GGGGS)2_Fc(216)_IgG1_C220S/PVA_/S267K/S364K/E357Q (SEQ ID NO:289)
*RNLPVATPDPGMFPCLHHSQNLLRAVSNMLQKARQTLEFYPCTSEEIDHEDITKDKTSTVEACLPLELTKQESCL*
*NSRETSFITQGSCLASRKTSFMMALCLSSIYEDLKMYQVEFKTMNAKLLMDPKRQIFLDQNMLAVIDELMQALNF*
*NSETVPQKSSLEEPDFYKTKIKLCILLHAFRIRAVTIDRVMSYLNAS*/GGGGSGGGGS/*EPKSSDKTHTCPPCPA*
*PPVAGPSVFLFPPKPKDTLMISRTPEVTCVVVDVKHEDPEVKFNWYVDGVEVHNAKTKPREEQYNSTYRVVSVLT*
*VLHQDWLNGKEYKCKVSNKALPAPIEKTISKAKGQPREPQVYTLPPSREQMTKNQVKLTCLVKGFYPSDIAVEWE*
*SNGQPENNYKTTPPVLDSDGSFFLYSKLTVDKSRWQQGNVFSCSVMHEALHNHYTQKSLSLSPGK*

Figure 67M

\>XENP33009_human_IL12p40(E59K/K99E/C252S/K264E)_(GGGGS)2-
human_IL12p35(N71Q/N195Q)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 - human_IL12p40(E59K/K99E/C252S/K264E)_(GGGGS)2_Fc(216)_IgG1_pI(-
)_Isosteric_A_C220S/PVA_/S267K/L368D/K370S (SEQ ID NO:430)
*IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS/<u>GGGGSGGGGS</u>/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK*

Chain 2 - human_IL12p35(N71Q/N195Q)_(GGGGS)2_Fc(216)_IgG1_C220S/PVA_/S267K/S364K/E357Q (SEQ ID NO:290)
*RNLPVATPDPGMFPCLHHSQNLLRAVSNMLQKARQTLEFYPCTSEEIDHEDITKDKTSTVEACLPLELTKQESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLQAS/<u>GGGGSGGGGS</u>/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK*

\>XENP33010_human_IL12p40(E59K/K99E/C252S/K264E)_(GGGGS)2-
human_IL12p35(N85Q/N195Q)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 - human_IL12p40(E59K/K99E/C252S/K264E)_(GGGGS)2_Fc(216)_IgG1_pI(-
)_Isosteric_A_C220S/PVA_/S267K/L368D/K370S (SEQ ID NO:431)
*IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS/<u>GGGGSGGGGS</u>/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK*

Chain 2 - human_IL12p35(N85Q/N195Q)_(GGGGS)2_Fc(216)_IgG1_C220S/PVA_/S267K/S364K/E357Q (SEQ ID NO:352)
*RNLPVATPDPGMFPCLHHSQNLLRAVSNMLQKARQTLEFYPCTSEEIDHEDITKDKTSTVEACLPLELTKNESCL
NSRETSFITQGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLQAS/<u>GGGGSGGGGS</u>/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK*

Figure 67N

>XENP33011 human_IL12p40(E59K/K99E/C252S/K264E)_(GGGGS)2-
human_IL12p35(N71Q/N85Q/N195Q)_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 - human_IL12p40(E59K/K99E/C252S/K264E)_(GGGGS)2_Fc(216)_IgG1_pI(-
)_Isosteric_A_C220S/PVA_/S267K/L368D/K370S (SEQ ID NO:383)

*IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS/*GGGGSGGGGS/*EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK*

Chain 2 - human_IL12p35(N71Q/N85Q/N195Q)_(GGGGS)2_Fc(216)_IgG1_C220S/PVA_/S267K/S364K/E357Q
(SEQ ID NO:354)

*RNLPVATPDPGMFPCLHHSQNLLRAVSNMLQKARQTLEFYPCTSEEIDHEDITKDKTSTVEACLPLELTKQESCL
NSRETSFITQGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLQAS/*GGGGSGGGGS/*EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK*

Open symbols: C252S
- XENP27201 [WT]
- XENP31251 [p40(E59K/K99Y)]
- XENP31254 [p40(D18K/E59K/K99E)]
- XENP31258 [p40(E59K/K99E/K264E)]
- XENP32186 [p40(D18K/E59K/K99E/K264E)]
- XENP32187 [p40(D18K/E59K/K99E/C252S)]
- XENP32188 [p40(D18K/E59K/K99E/C252S/K264E)]
- XENP32189 [p40(E59K/K99Y/C252S)]
- XENP32190 [p40(E59K/K99E/C252S/K264E)]
- XENP32191 [p40(E59K/K99E/C252S)]

Figure 69

Human PD-1 sequence (SEQ ID NO:468)
>sp|Q15116
MQIPQAPWPVVWAVLQLGWRPGWFLDSPDRPWNPPTFSPALLVVTEGDNATFTCSFSNTSESFVLNWYRMSPSNQ
TDKLAAFPEDRSQPGQDCRFRVTQLPNGRDFHMSVVRARRNDSGTYLCGAISLAPKAQIKESLRAELRVTERRAE
VPTAHPSPSPRPAGQFQTLVVGVVGGLLGSLVLLVWVLAVICSRAARGTIGARRTGQPLKEDPSAVPVFSVDYGE
LDFQWREKTPEPPVPCVPEQTEYATIVFPSGMGTSSPARRGSADGPRSAQPLRPEDGHCSWPL

Human PD-1 sequence, extracellular domain (SEQ ID NO:469)
>sp|Q15116|21-170
PGWFLDSPDRPWNPPTFSPALLVVTEGDNATFTCSFSNTSESFVLNWYRMSPSNQTDKLAAFPEDRSQPGQDCRF
RVTQLPNGRDFHMSVVRARRNDSGTYLCGAISLAPKAQIKESLRAELRVTERRAEVPTAHPSPSPRPAGQFQTLV

Macaca fascicularis PD-1 sequence (SEQ ID NO:470)
>tr|B0LAJ3
MQIPQAPWPVVWAVLQLGWRPGWFLESPDRPWNAPTFSPALLLVTEGDNATFTCSFSNASESFVLNWYRMSPSNQ
TDKLAAFPEDRSQPGQDCRFRVTRLPNGRDFHMSVVRARRNDSGTYLCGAISLAPKAQIKESLRAELRVTERRAE
VPTAHPSPSPRPAGQFQALVVGVVGGLLGSLVLLVWVLAVICSRAAQGTIEARRTGQPLKEDPSAVPVFSVDYGE
LDFQWREKTPEPPAPCVPEQTEYATIVFPSGLGTSSPARRGSADGPRSPRPLRPEDGHCSWPL

Macaca fascicularis PD-1 sequence, extracellular domain (predicted) (SEQ ID NO:471)
>tr|B0LAJ3|21-170
PGWFLESPDRPWNAPTFSPALLLVTEGDNATFTCSFSNASESFVLNWYRMSPSNQTDKLAAFPEDRSQPGQDCRF
RVTRLPNGRDFHMSVVRARRNDSGTYLCGAISLAPKAQIKESLRAELRVTERRAEVPTAHPSPSPRPAGQFQALV

Human PD-L1 sequence (SEQ ID NO:472)
>sp|Q9NZQ7
MRIFAVFIFMTYWHLLNAFTVTVPKDLYVVEYGSNMTIECKFPVEKQLDLAALIVYWEMEDKNIIQFVHGEEDLK
VQHSSYRQRARLLKDQLSLGNAALQITDVKLQDAGVYRCMISYGGADYKRITVKVNAPYNKINQRILVVDPVTSE
HELTCQAEGYPKAEVIWTSSDHQVLSGKTTTTNSKREEKLFNVTSTLRINTTTNEIFYCTFRRLDPEENHTAELV
IPELPLAHPPNERTHLVILGAILLCLGVALTFIFRLRKGRMMDVKKCGIQDTNSKKQSDTHLEET

Human PD-L1 sequence, extracellular domain (SEQ ID NO:473)
>sp|Q9NZQ7|19-238
FTVTVPKDLYVVEYGSNMTIECKFPVEKQLDLAALIVYWEMEDKNIIQFVHGEEDLKVQHSSYRQRARLLKDQLS
LGNAALQITDVKLQDAGVYRCMISYGGADYKRITVKVNAPYNKINQRILVVDPVTSEHELTCQAEGYPKAEVIWT
SSDHQVLSGKTTTTNSKREEKLFNVTSTLRINTTTNEIFYCTFRRLDPEENHTAELVIPELPLAHPPNER

Macaca fascicularis PD-L1 sequence (SEQ ID NO:474)
>tr|G7PSE7
MRIFAVFIFTIYWHLLNAFTVTVPKDLYVVEYGSNMTIECKFPVEKQLDLTSLIVYWEMEDKNIIQFVHGEEDLK
VQHSNYRQRAQLLKDQLSLGNAALRITDVKLQDAGVYRCMISYGGADYKRITVKVNAPYNKINQRILVVDPVTSE
HELTCQAEGYPKAEVIWTSSDHQVLSGKTTTTNSKREEKLLNVTSTLRINTTANEIFYCIFRRLDPEENHTAELV
IPELPLALPPNERTHLVILGAIFLLLGVALTFIFYLRKGRMMDMKKCGIRVTNSKKQRDTQLEET

Macaca fascicularis PD-L1 sequence, extracellular domain (predicted) (SEQ ID NO:475)
>tr|G7PSE7|19-238
FTVTVPKDLYVVEYGSNMTIECKFPVEKQLDLTSLIVYWEMEDKNIIQFVHGEEDLKVQHSNYRQRAQLLKDQLS
LGNAALRITDVKLQDAGVYRCMISYGGADYKRITVKVNAPYNKINQRILVVDPVTSEHELTCQAEGYPKAEVIWT
SSDHQVLSGKTTTTNSKREEKLLNVTSTLRINTTANEIFYCIFRRLDPEENHTAELVIPELPLALPPNER

Figure 70A

>1C11[PD-1]_H0L0 Variable Heavy Chain (SEQ ID NO: 476)
QIQLVQSGPELKKPGETVKISCRASGYTFTHYGMNWVKQAPGKGLKWMGWINTYTGEPTYADDFKGRFAFSLETSASTAYLQINNLRNED
TATYFCARDYYGSSPYWGQGTTLTVSS >1C11[PD-1]_H0L0 Variable Light Chain (SEQ ID NO: 477)
DVLMTQTPLSLPVSLGDQASISCRSSQSIVHSNGNTYLEWYLQKPGQSPKLLIYKVSNRFSGVPDRFSGSGSGTDFTLKISRVEAEDLGV
YYCFQGSHVPNTFGGGTKLEIK >1C11[PD-1]_H3L3 Variable Heavy Chain (SEQ ID NO: 478)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS >1C11[PD-1]_H3L3 Variable Light Chain (SEQ ID NO: 479)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQGSHVPNTFGGGTKVEIK >1C11[PD-1]_H3.240_L3.148 Variable Heavy Chain (SEQ ID NO: 480)
QVQLVQSGPELKKPGESVKVSCKASGYTFTHYGINWVRQPPGQGLEWMGWINTYTGEPYYAPGFQERFVFSIDTS
QDTAYLQINSLKAEDTAVYYCARDYYGSSPYWGQGTLVTVSS >1C11[PD-1]_H3.240_L3.148 Variable Light Chain (SEQ ID NO: 481)
DIVMTQSPDSLAVSLGERVTINCKASQSIVHSNGNTYLEWYQQKPGQAPKLLIYKVSNRFSGVPDRFSGSGSGTD
FTLTISSVEAEDAATYYCFQGSHVPNTFGQGTKVEIK >1C11[PD-1]_H3.241_L3.148 Variable Heavy Chain (SEQ ID NO: 482)
EVQLVQSGPELKKPGESVKVSCKASGYTFTHYGINWVRQPPGQGLEWMGWINTYTGEPYYAPGFQERFVFSIDTS
QDTAYLQINSLKAEDTAVYYCARDYYGSSPYWGQGTLVTVSS >1C11[PD-1]_H3.241_L3.148 Variable Light Chain (SEQ ID NO: 483)
DIVMTQSPDSLAVSLGERVTINCKASQSIVHSNGNTYLEWYQQKPGQAPKLLIYKVSNRFSGVPDRFSGSGSGTD
FTLTISSVEAEDAATYYCFQGSHVPNTFGQGTKVEIK >1C11[PD-1]_H3.234_L3.144 Variable Heavy Chain (SEQ ID NO: 484)
EVQLVQSGSELKKPGESVKVSCKASGYTFTHYGINWVRQPPGQGLEWMGWINTYTGEPYYAPGFQERFVFSIDTS
QDTAYLQINSLKAEDTAVYYCARDYYGSSPYWGQGTLVTVSS >1C11[PD-1]_H3.234_L3.144 Variable Light Chain (SEQ ID NO: 485)
DIVMTQSPDSLAVSLGERVTINCKASQSIVHSNGNTYLEWYQQKPGQPPKLLIYKVSNRFSGVPDRFSGSGSGTD
FTLTISSVEAEDAATYYCFQGSRVPNTFGQGTKVEIK >1C11[PD-1]_H3.241_L3.92 Variable Heavy Chain (SEQ ID NO: 486)
EVQLVQSGPELKKPGESVKVSCKASGYTFTHYGINWVRQPPGQGLEWMGWINTYTGEPYYAPGFQERFVFSIDTS
QDTAYLQINSLKAEDTAVYYCARDYYGSSPYWGQGTLVTVSS >1C11[PD-1]_H3.241_L3.92 Variable Light Chain (SEQ ID NO: 487)
DIVMTQSPDSLAVSLGERVTINCKASQSIVHSNGNTYLEWYQQKPGQPPKLLIYKVSNRFTGVPDRFSGSGSGTD
FTLTISSLQAEDVAVYYCFQGSRVPNTFGGGTKVEIK >1C11[PD-1]_H3.303_L3.152 Variable Heavy Chain (SEQ ID NO: 488)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS

Figure 70B

>1C11[PD-1]_H3.303_L3.152 Variable Light Chain (SEQ ID NO: 489)
DVLMTQSPDSLAVSLGERATINCKSSQSIVFSNGNTYLEWYQQKPGQSPKLLIYKVSNRFSGVPDRFSGSGSGTD
FTLTISSLQAEDVAVYYCFQGSHVPNTFGGGTKVEIK >1C11_H3.329_L3.220 Variable Heavy Chain (SEQ ID NO: 490)
QIQLVQSGSELLKPGASVSVSCKASGYTFTHYGMNWVRQAPGQGLEWMGWINTHTGEPTYADGFTGRFVFSLDTS
VSTAYLQISSLKAEDTAVYFCARDYFGSSPYWGQGTLVTVSS >1C11_H3.329_L3.220 Variable Light Chain (SEQ ID NO: 491)
DILMTQSPDSLAVSLGERATINCKSSQSIVYSNGNNYLEWYQQKPGQSPKLLIYKVSNRFSGVPDRFSGSGSGTD
FTLTISSLQAEDVAVYYCFQGSHVPNTFGGGTKVEIK >1C11_H3.328_L3.152 Variable Heavy Chain (SEQ ID NO: 492)
QIQLVQSGSELKKPGASVSVSCKASGYTFTHYGMNWVRQAPGQGLEWMGWINTHTGEPTYADGFTGRFVFSLDTS
VSTAYLQISSLKAEDTAVYFCARDYFGSSPYWGQGTLVTVSS >1C11_H3.328_L3.152 Variable Light Chain (SEQ ID NO: 493)
DVLMTQSPDSLAVSLGERATINCKSSQSIVFSNGNTYLEWYQQKPGQSPKLLIYKVSNRFSGVPDRFSGSGSGTD
FTLTISSLQAEDVAVYYCFQGSHVPNTFGGGTKVEIK >pembrolizumab[PD-1] variable heavy Chain (SEQ ID NO: 494)
QVQLVQSGVEVKKPGASVKVSCKASGYTFTNYYMYWVRQAPGQGLEWMGGINPSNGGTNFNEKFKNRVTLTTDSS
TTTAYMELKSLQFDDTAVYYCARRDYRFDMGFDYWGQGTTVTVSS >pembrolizumab[PD-1] variable light Chain (SEQ ID NO: 495)
EIVLTQSPATLSLSPGERATLSCRASKGVSTSGYSYLHWYQQKPGQAPRLLIYLASYLESGVPARFSGSGSGTDF
TLTISSLEPEDFAVYYCQHSRDLPLTFGGGTKVEIK >nivolumab[PD-1] variable heavy Chain (SEQ ID NO: 496)
QVQLVESGGGVVQPGRSLRLDCKASGITFSNSGMHWVRQAPGKGLEWVAVIWYDGSKRYYADSVKGRFTISRDNS
KNTLFLQMNSLRAEDTAVYYCATNDDYWGQGTLVTVSS >nivolumab[PD-1] variable light Chain (SEQ ID NO: 497)
EIVLTQSPATLSLSPGERATLSCRASQSVSSYLAWYQQKPGQAPRLLIYDASNRATGIPARFSGSGSGTDFTLTI
SSLEPEDFAVYYCQQSSNWPRTFGQGTKVEIK >pidilizumab[PD-1] variable heavy Chain (SEQ ID NO: 498)
QVQLVQSGSELKKPGASVKISCKASGYTFTNYGMNWVRQAPGQGLQWMGWINTDSGESTYAEEFKGRFVFSLDTS
VNTAYLQITSLTAEDTGMYFCVRVGYDALDYWGQGTLVTVSS >pidilizumab[PD-1] variable light Chain (SEQ ID NO: 499)
EIVLTQSPSSLSASVGDRVTITCSARSSVSYMHWFQQKPGKAPKLWIYRTSNLASGVPSRFSGSGSGTSYCLTIN
SLQPEDFATYYCQQRSSFPLTFGGGTKLEIK >MK-3475[PD-1] variable heavy Chain (SEQ ID NO: 500)
QVQLVQSGVEVKKPGASVKVSCKASGYTFTNYYMYWVRQAPGQGLEWMGGINPSNGGTNFNEKFKNRVTLTTDSS
TTTAYMELKSLQFDDTAVYYCARRDYRFDMGFDYWGQGTTVTVSS >MK-3475[PD-1] variable light Chain (SEQ ID NO: 501)
EIVLTQSPATLSLSPGERATLSCRASKGVSTSGYSYLHWYQQKPGQAPRLLIYLASYLESGVPARFSGSGSGTDF
TLTISSLEPEDFAVYYCQHSRDLPLTFGGGTKVEIK

Figure 70C

\>BAP049 Clone E[PD-1] variable heavy Chain (SEQ ID NO: 502)
EVQLVQSGAEVKKPGESLRISCKGSGYTFTTYWMHWVRQATGQGLEWMGNIYPGTGGSNFDEKFKNRVTITADKS
TSTAYMELSSLRSEDTAVYYCTRWTTGTGAYWGQGTTVTVSS \>BAP049 Clone E[PD-1] variable light Chain (SEQ ID NO: 503)
EIVLTQSPATLSLSPGERATLSCKSSQSLLDSGNQKNFLTWYQQKPGQAPRLLIYWASTRESGVPSRFSGSGSGT
DFTFTISSLEAEDAATYYCQNDYSYPYTFGQGTKVEIK \>BAP049 Clone B[PD-1] variable heavy Chain (SEQ ID NO: 504)
EVQLVQSGAEVKKPGESLRISCKGSGYTFTTYWMHWVRQATGQGLEWMGNIYPGTGGSNFDEKFKNRVTITADKS
TSTAYMELSSLRSEDTAVYYCTRWTTGTGAYWGQGTTVTVSS \>BAP049 Clone B[PD-1] variable light Chain (SEQ ID NO: 505)
EIVLTQSPATLSLSPGERATLSCKSSQSLLDSGNQKNFLTWYQQKPGKAPKLLIYWASTRESGVPSRFSGSGSGT
DFL \>H7798N[PD-1] variable heavy Chain (SEQ ID NO: 506)
EVQLLESGGVLVQPGGSLRLSCAASGFTFSNFGMTWVRQAPGKGLEWVSGISGGGRDTYFADSVKGRFTISRDNS
KNTLYLQMNSLKGEDTAVYYCVKWGNIYFDYWGQGTLVTVSS \>H7709N[PD-1] variable light Chain (SEQ ID NO: 507)
DIQMTQSPSSLSASVGDSITITCPASLSINTFLNWYQQKPGKAPNLLIYAASSLHGGVPSRFSGSGSGTDFTLTI
RTLQPEDFATYYCQQSSNTPFTFGPGTVVDFR \>h1H3 Var 6[PD-1] variable heavy Chain (SEQ ID NO: 508)
EVQLVESGGGLVQPGGSLRLSCAASGFTFSDYGMHWVRQAPGKGLEWVAYISSGSYTIYYADSVKGRFTISRDNA
KNTLYLQMSSLRAEDTAVYYCARRGYGSFYEYYFDYWGQGTTVTVSS \>h1H3 Var 6[PD-1] variable light Chain (SEQ ID NO: 509)
QIVLTQSPATLSLSPGERATLSCSASSSVSYMYWYQQKPGQAPRLLIYLTSNRATGIPARFSGSGSGTDYTLTIS
SLEPEDFAVYYCQQWSSNPFTFGQGTKLEIK \>APE2058[PD-1] variable heavy Chain (SEQ ID NO: 510)
EVQLLESGGGLVQPGGSLRLSCAASGFTFSSYDMSWVRQAPGKGLEWVSTISGGGSYTYYQDSVKGRFTISRDNS
KNTLYLQMNSLRAEDTAVYYCASPYYAMDYWGQGTTVTVSS \>APE2058[PD-1] variable light Chain (SEQ ID NO: 511)
DIQLTQSPSFLSAYVGDRVTITCKASQDVGTAVAWYQQKPGKAPKLLIYWASTLHTGVPSRFSGSGSGTEFTLTI
SSLQPEDFATYYCQHYSSYPWTFGQGTKLEIK \>H005-1[PD-1] variable heavy Chain (SEQ ID NO: 512)
EVQLVESGGGLVQPGGSLRLSCAASGFTFSSYMMSWVRQAPGKGLEWVATISGGGANTYYPDSVKGRFTISRDNA
KNSLYLQMNSLRAEDTAVYYCARQLYYFDYWGQGTTVTVSS \>H005-1[PD-1] variable light Chain (SEQ ID NO: 513)
DIQMTQSPSSLSASVGDRVTITCLASQTIGTWLTWYQQKPGKAPKLLIYTATSLADGVPSRFSGSGSGTDFTLTI
SSLQPEDFATYYCQQVYSIPWTFGGGTKVEIK \>317-4B6[PD-1] variable heavy Chain (SEQ ID NO: 514)
QVQLQESGPGLVKPSETLSLTCTVSGFSLTSYGVHWIRQPPGKGLEWIGVIYADGSTNYNPSLKSRVTISKDTSK
NQVSLKLSSVTAADTAVYYCARAYGNYWYIDVWGQGTTVTVSS

Figure 70D

>317-4B6[PD-1] variable light Chain (SEQ ID NO: 515)
DIVMTQSPDSLAVSLGERATINCKSSESVSNDVAWYQQKPGQPPKLLINYAFHRFTGVPDRFSGSGYGTDFTLTI
SSLQAEDVAVYYCHQAYSSPYTFGQGTKLEIK

>326-4A3[PD-1] variable heavy Chain (SEQ ID NO: 516)
QVQLVQSGSELKKPGASVKVSCKASGYTFTNYGMNWVRQAPGQGLKWMGWINNNNAEPTYAQDFRGRFVFSLDTS
ASTAYLQISSLKTEDTAVYYCARDVMDYWGQGTLVTVSS

>326-4A3[PD-1] variable light Chain (SEQ ID NO: 517)
DIVLTQSPASLAVSPGQRATITCRASESVDNYGISFMHWYQQKPGQPPKLLIYRASNLESGVPARFSGSGSGTDF
TLTINPVEAEDTANYYCQQSKEYPTFGGGTKVEIK

>hPD-1 mAb 7 (1.2)[PD-1] variable heavy Chain (SEQ ID NO: 518)
QVQLVQSGAEVKKPGASVKVSCKASGYSFTSYWMNWVRQAPGQGLEWIGVIHPSDSETWLDQKFKDRVTITVDKS
TSTAYMELSSLRSEDTAVYYCAREHYGTSPFAYWGQGTLVTVSS

>hPD-1 mAb 7 (1.2)[PD-1] variable light Chain (SEQ ID NO: 519)
EIVLTQSPATLSLSPGERATLSCRASESVDNYGMSFMNWFQQKPGQPPKLLIHAASNQGSGVPSRFSGSGSGTDF
TLTISSLEPEDFAVYFCQQSKEVPYTFGGGTKVEIK

>Clone 38[PD-1] variable heavy Chain (SEQ ID NO: 520)
QGQLVQSGAEVKKPGASVKVSCKASGYTFTDYEMHWVRQAPIHGLEWIGVIESETGGTAYNQKFKGRVTITADKS
TSTAYMELSSLRSEDTAVYYCAREGITTVATTYYWYFDVWGQGTTVTVSS

>Clone 38[PD-1] variable light Chain (SEQ ID NO: 521)
DVVMTQSPLSLPVTLGQPASISCRSSQSIVHSNGNTYLEWYLQKPGQSPQLLIYKVSNRFSGVPDRFSGSGSGTD
FTLKISRVEAEDVGVYYCFQGSHVPLTFGQGTKLEIK

>Clone 39[PD-1] variable heavy Chain (SEQ ID NO: 522)
QGQLVQSGAEVKKPGASVKVSCKASGYTFTDYEMHWVRQAPGQGLEWMGVIESETGGTAYNQKFKGRAKITADKS
TSTAYMELSSLRSEDTAVYYCTREGITTVATTYYWYFDVWGQGTTVTVSS

>Clone 39[PD-1] variable light Chain (SEQ ID NO: 523)
DVVMTQSPLSLPVTLGQPASISCRSSQSIVHSNGNTYLEWYLQKPGQSPQLLIYKVSNRFSGVPDRFSGSGSGTD
FTLKISRVEAEDVGVYYCFQGSHVPLTFGQGTKLEIK

>Clone 41[PD-1] variable heavy Chain (SEQ ID NO: 524)
QGQLVQSGAEVKKPGASVKVSCKASGYTFTDYEMHWVRQAPGQGLEWMGVIESETGGTAYNQKFQGRVTLTADKS
SSTAYMELSSLRSEDTAVYYCTREGITTVATTYYWYFDVWGQGTLVTVSS

>Clone 41[PD-1] variable light Chain (SEQ ID NO: 525)
DVVMTQSPLSLPVTLGQPASISCRSSQSIVHSNGNTYLEWYLQKPGQSPQLLIYKVSNRFSGVPDRFSGSGSGTD
FTLKISRVEAEDVGVYYCFQGSHVPLTFGQGTKLEIK

>Clone 48[PD-1] variable heavy Chain (SEQ ID NO: 526)
QGQLVQSGAEVKKPGASVKVSCKASGYTFTDYEMHWVRQAPGQGLEWMGVIESETGGTAYNQKFKGRAKITADKS
TSTAYMELSSLRSEDTAVYYCTREGITTVATTYYWYFDVWGQGTTVTVSS

>Clone 48[PD-1] variable light Chain (SEQ ID NO: 527)
DVVMTQSPLSLPVTLGQPASISCRSSQSIVHSNGNTYLEWYLQKPGQSPRLLIYKVSNRFSGVPDRFSGSGSGTD
FTLKISRVEAEDVGVYYCFQGSHVPLTFGQGTKLEIK

Figure 70E

>PD1-17[PD-1] variable heavy Chain (SEQ ID NO: 528)
QVQLQESGPGVVKPSGTLSLTCAISGGSIGSGGSIRSTRWWSWVRQSPGKGLEWIGEIYHSGSTNYNPSLKSRVT
ISLDKSRNHFSLRLNSVTAADTAVYYCARQDYGDSGDWYFDLWGKGTMVTVSS

>PD1-17[PD-1] variable light Chain (SEQ ID NO: 529)
NFMLTQPHSVSESPGKTVTISCTRSSGSIASNSVQWYQQRPGSSPTTVIYEDNQRPSGVPDRFSGSIDSSSNSAS
LTVSGLKTEDEADYYCQSSDSSAVVFGSGTRLTVL

>PD1-28[PD-1] variable heavy Chain (SEQ ID NO: 530)
EVQLVQSGAEVKKPGASVKVSCKASGYRFTSYGISWVRQAPGQGLEWMGWISAYNGNTNYAQKLQGRVTMTTDTS
TNTAYMELRSLRSDDTAVYYCARDADYSSGSGYWGQGTLVTVSS

>PD1-28[PD-1] variable light Chain (SEQ ID NO: 531)
SYELTQPPSVSVSPGQTARITCSGDALPKQYAYWYQQKPGQAPVMVIYKDTERPSGIPERFSGSSSGTKVTLTIS
GVQAEDEADYYCQSADNSITYRVFGGGTKVTVL

>PD1-33[PD-1] variable heavy Chain (SEQ ID NO: 532)
QVQLVQSGAEVKKPGASVRVSCKASGYTLTSYYIHWVRQAPGQGLEWMGIINPRGATISYAQKFQGRVTMTRDTS
TSTVYMELRNLKSEDTALYYCATAGIYGFDFDYWGRGTLVTVSS

>PD1-33[PD-1] variable light Chain (SEQ ID NO: 533)
QSALTQPASVSGSPGQSITISCTGTSNDVGGYNYVSWYQHHPGKAPKLIIYDVTNRPSGVSDRFSGSKSGNTASL
TISGLLAEDEGDYYCSSYTLVTNFEVLFGGGTKLTV

>PD1-35[PD-1] variable heavy Chain (SEQ ID NO: 534)
QVQLQESGPGLVKPSQTLSLTCTVSGGSISSGAYYWSWIRQHPGKGLEWIGYIYYNGNTYYNPSLRSLVTISVDA
SKNQFSLKLSSVTAADTAVYYCARASDYVWGGYRYMDAFDIWGRGTLITVSS

>PD1-35[PD-1] variable light Chain (SEQ ID NO: 535)
QSVLTQPPSASGTPGQRVTISCSGSNSNIGSNSVNWYQQLPGTAPKLLIYGNNQRPSGVPDRFSGSKSGTSASLA
ISGLQSENEADYYCAAWDDSLNGPVFGRGTKVTVLGE

>LOPD180[PD-1] variable heavy Chain (SEQ ID NO: 536)
QVQLQESGPGLVKPSQTLSLTCTVSGGSISSGAYYWSWIRQHPGKGLEWIGYIYYNGNTYYNPSLRSRVTISVDT
SKNQFSLKLSSVTAADTAVYYCVRASDYVWGGYHYFDAFDLWGRGTLVTVSS

>LOPD180[PD-1] variable light Chain (SEQ ID NO: 537)
QSVLTQPPSASGTPGQRVTISCSGSNSNIGSNSVNWYQQLPGTAPKLLIYGNNQRPSGVPDRFSGSKSGTSASLA
ISGLQSEDEADYYCAAWDDSLNGPVFGGGTKVTVL

>Ab948[PD-1] variable heavy Chain (SEQ ID NO: 538)
EVQLQESGPGLVKPSQTLSLTCTVTGYSITSDYAWNWIRQPPGKKLEWMGYINYSGSTSYNPSLKSRVTISRDTS
KNQFSLKLSSVTAADTAVYYCARWIGSSAWYFDVWGQGTLVTVS

>Ab948[PD-1] variable light Chain (SEQ ID NO: 539)
DVLMTQTPLSLSVTPGQPASISCKSGQNIVHSNGNTYLEWYLQKPGQSPKLLIYKVSNRFFGVPDRISGSGSGTD
FTLKISRVEAEDVGVYFCFQGSHVPFTFGQGTKLEIK

>humanized EH-12.2H7[PD-1] variable heavy Chain (SEQ ID NO: 540)
QVQLVQSGHEVKQPGASVKMSCKASGYSFTSSWIHWVRQAPGQGLEWIGYIYPSTGFTEYNQKFKDRATLTADKS
TSTAYMELSSLRSEDTAVYYCARWRDSSGYRAMDYWGQGTLVTVSS

Figure 70F

>humanized EH-12.2H7[PD-1] variable light Chain (SEQ ID NO: 541)
EIVLTQSPATLSLSPGQRLTISCRASQSVSTSGYSYMHWYQQKPDQSPKLLIKFGSNLESGIPARFSGSGSGTDF
TLTISSLEPEDFATYYCQHSWEIPYTFGQGTKLEIK >RG1H10[PD-1] variable heavy Chain (SEQ ID NO: 542)
QVQLVQSGSELKKPGASVKISCKASGYIFSDNGVNWVRQAPGQGLEWMGWINTKIGNPTYAQGFTGRFVFSLDTS
ISTTYLQISSLQAGDTAVYYCAREHDYYYGMDVWGQGTTVTVSS >RG1H10[PD-1] variable light Chain (SEQ ID NO: 543)
QSALTQPPSASGSPGQSVTISCTGTSSDVGGYNYVSWYQHHPGKAPKLMIYEVSKRPSGVPDRFSGSKSAITASL
TISGLLTEDEADYYCSAWDDSLNADVFGGGTKVTVL >RG1H10-H2A-22-1S[PD-1] variable heavy Chain (SEQ ID NO: 544)
QVQLVQSGSELKKPGASVKISCKASGYIFSDNGVNWVRQAPGQGLEWMGWINTKDGNPTYAQGFTGRFVFSLDTS
ISTTYLQISSLQAGDTAVYYCAREHDYYYGMDVWGQGTTVTVSS >RG1H10-H2A-22-1S[PD-1] variable light Chain (SEQ ID NO: 545)
QSALTQPPSASGSPGQSVTISCTGTSSDVGGYNYVSWYQHHPGKAPKLMIYEVSKRPSGVPDRFSGSKSAITASL
TISGLLTEDEADYYCSAWDDSLNADVFGGGTKVTVL >RG1H10-H2A-27-2S[PD-1] variable heavy Chain (SEQ ID NO: 546)
QVQLVQSGSELKKPGASVKISCKASGYIFSDNGVNWVRQAPGQGLEWMGWINTKTGNPTYAQGFTGRFVFSLDTS
ISTTYLQISSLQAGDTAVYYCAREHDYYYGMDVWGQGTTVTVSS >RG1H10-H2A-27-2S[PD-1] variable light Chain (SEQ ID NO: 547)
QSALTQPPSASGSPGQSVTISCTGTSSDVGGYNYVSWYQHHPGKAPKLMIYEVSKRPSGVPDRFSGSKSAITASL
TISGLLTEDEADYYCSAWDDSLNADVFGGGTKVTVL >RG1H10-3C[PD-1] variable heavy Chain (SEQ ID NO: 548)
QVQLVQSGSELKKPGASVKISCKASGYTFSDNGVNWVRQAPGQGLEWMGWINTKDGNPTYAQGFTGRFVFSLDTS
ISTTYLQISSLQAGDTAVYYCAREHDYYYGMDVWGQGTTVTVSS >RG1H10-3C[PD-1] variable light Chain (SEQ ID NO: 549)
QSALTQPPSASGSPGQSVTISCTGTSSDVGGYNYVSWYQHHPGKAPKLMIYEVSKRPSGVPDRFSGSKSAITASL
TISGLLTEDEADYYCSAWDDSLNADVFGGGTKVTVL >RG1H10-16C[PD-1] variable heavy Chain (SEQ ID NO: 550)
QVQLVQSGSELKKPGASVKISCKASGYTFSDNGVNWVRQAPGQGLEWMGWINTKTGNPTYAQGFTGRFVFSLDTS
ISTTYLQISSLQAGDTAVYYCAREHDYYYGMDVWGQGTTVTVS >RG1H10-16C[PD-1] variable light Chain (SEQ ID NO: 551)
QSALTQPPSASGSPGQSVTISCTGTSSDVGGYNYVSWYQHHPGKAPKLMIYEVSKRPSGVPDRFSGSKSAITASL
TISGLLTEDEADYYCSAWDDSLNADVFGGGTKVTVL >RG1H10-17C[PD-1] variable heavy Chain (SEQ ID NO: 552)
QVQLVQSGSELKKPGASVKISCKASGYKFSDNGVNWVRQAPGQGLEWMGWINTKSGNPTYAQGFTGRFVFSLDTS
ISTTYLQISSLQAGDTAVYYCAREHDYYYGMDVWGQGTTVTVSS >RG1H10-17C[PD-1] variable light Chain (SEQ ID NO: 553)
QSALTQPPSASGSPGQSVTISCTGTSSDVGGYNYVSWYQHHPGKAPKLMIYEVSKRPSGVPDRFSGSKSAITASL
TISGLLTEDEADYYCSAWDDSLNADVFGGGTKVTVL

Figure 70G

>RG1H10-19C[PD-1] variable heavy Chain (SEQ ID NO: 554)
QVQLVQSGSELKKPGASVKISCKASGYKFSDNGVNWVRQAPGQGLEWMGWINTKTGNPTYAQGFTGRFVFSLDTS
ISTTYLQISSLQAGDTAVYYCAREHDYYYGMDVWGQGTTVTVSS >RG1H10-19C[PD-1] variable light Chain (SEQ ID NO: 555)
QSALTQPPSASGSPGQSVTISCTGTSSDVGGYNYVSWYQHHPGKAPKLMIYEVSKRPSGVPDRFSGSKSAITASL
TISGLLTEDEADYYCSAWDDSLNADVFGGGTKVTVL >RG1H10-21C[PD-1] variable heavy Chain (SEQ ID NO: 556)
QVQLVQSGSELKKPGASVKISCKASGYTFSDNGVNWVRQAPGQGLEWMGWINTKSGNPTYAQGFTGRFVFSLDTS
ISTTYLQISSLQAGDTAVYYCAREHDYYYGMDVWGQGTTVTVSS >RG1H10-21C[PD-1] variable light Chain (SEQ ID NO: 557)
QSALTQPPSASGSPGQSVTISCTGTSSDVGGYNYVSWYQHHPGKAPKLMIYEVSKRPSGVPDRFSGSKSAITASL
TISGLLTEDEADYYCSAWDDSLNADVFGGGTKVTVL >RG1H10-23C2[PD-1] variable heavy Chain (SEQ ID NO: 558)
QVQLVQSGSELKKPGASVKISCKASGYKFSDNGVNWVRQAPGQGLEWMGWINTKDGNPTYAQGFTGRFVFSLDTS
ISTTYLQISSLQAGDTAVYYCAREHDYYYGMDVWGQGTTVTVSS >RG1H10-23C2[PD-1] variable light Chain (SEQ ID NO: 559)
QSALTQPPSASGSPGQSVTISCTGTSSDVGGYNYVSWYQHHPGKAPKLMIYEVSKRPSGVPDRFSGSKSAITASL
TISGLLTEDEADYYCSAWDDSLNADVFGGGTKVTVL >mAb7[PD-1] variable heavy Chain (SEQ ID NO: 560)
QVQLVQSGAEVKKPGASVKVSCKASGYTFTSYWINWVRQAPGQGLEWMGNIYPGSSLTNYNEKFKNRVTMTRDTS
TSTVYMELSSLRSEDTAVYYCARLSTGTFAYWGQGTLVTVSS >mAb7[PD-1] variable light Chain (SEQ ID NO: 561)
DIVMTQSPDSLAVSLGERATINCKSSQSLWDSGNQKNFLTWYQQKPGQPPKLLIYWTSYRESGVPDRFSGSGSGT
DFTLTISSLQAEDVAVYYCQNDYFYPRTFGGGTKVEIK >PD1AB-6[PD-1] variable heavy Chain (SEQ ID NO: 562)
EVQLVQSGAEVKKPGATVKISCKASGFNIKDTYMHWVQQAPGKGLEWMGRIDPANGDRKYDPKFQGRVTITADTS
TDTAYMELSSLRSEDTAVYYCARSGPVYYYGSSYMDYWGQGTTVTVSS >PD1AB-6[PD-1] variable light Chain (SEQ ID NO: 563)
DIVMTQSPDSLAVSLGERATINCKSGQSVLYSSNQKNFLAWYQQKPGQPPKLLIYWASTRESGVPDRFSGSGSGT
DFTLTISSLQAEDVAVYYCHQYLYSWTFGQGTKLEIK mAb A[PD-1]_H1 Variable Heavy (SEQ ID NO: 564)
QVQLQESGPGLVKPSQTLSLTCTVSGHSITSDYAWNWIRQPPGKKLEWIGYISYSGYTTYNPSLKSRVTISRDTS
KNQFSLKLSSVTAADTAVYFCARDLDYGPWFAYWGQGTLVTVSS mAb A[PD-1]_L1 Variable Light (SEQ ID NO: 565)
DIQMTQSPSSLSASVGDRVTITCRASENIHNYLAWYQQKPGKSPKLLVYNVKTLADGVPSRFSGSGSGTDYTLTI
SSLQPEDFATYYCQHFWSSPWTFGGGTKVEIK mAb B[PD-1]_H1 Variable Heavy (SEQ ID NO: 566)
QVQLVQSGAEVKKPGASVKVSCKASGYTFTNFYIHWVRQAPGQSIEWMGSIYPNYGDTAYNQKFQGRVTMTVDKS
ISTAYMELSRLRSDDTAVYYCARGYSYAMDYWGQGTTVTVSS

Figure 70H mAb B[PD-1]_L1 Variable Light (SEQ ID NO: 567)
DIQMTQSPSSLSASVGDRVTITCRASQGISGDLNWYQQKPGKTVKLLIYHTSSLHSGVPLRFSGSGSGTDYTLTI
SSLQPEDFATYYCQYYSKDLLTFGAGTKLEIK mAb C[PD-1]_H1 Variable Heavy (SEQ ID NO: 568)
EVQLVESGGGLVQPGGSLRLSCAASGFTFSSFGMHWVRQAPGKGLEWVSYISSGSSIIYYADSVKGRFTISRDNA
KNSLYLQMNSLRAEDTAVYYCARGGRLVWSPDYWGQGTLVTVSS mAb C[PD-1]_H1.19 Variable Heavy (SEQ ID NO: 569)
EVQLVESGGGLVQPGGSLRLSCAASGFTFSSLGMHWVRQAPGKGLEWVSYISSGSSIIYYADSVKGRFTISRDNA
KNSLYLQMNSLRAEDTAVYYCARGGRLVWSPDYWGQGTLVTVSS mAb C[PD-1]_H1.48 Variable Heavy (SEQ ID NO: 570)
EVQLVESGGGLVQPGGSLRLSCAASGFTFSSFGMHWVRQAPGKGLEWVSYISGGSSIIYYADSVKGRFTISRDNA
KNSLYLQMNSLRAEDTAVYYCARGGRLVWSPDYWGQGTLVTVSS mAb C[PD-1]_H1.125 Variable Heavy (SEQ ID NO: 571)
EVQLVESGGGLVQPGGSLRLSCAASGFTFSSFGMHWVRQAPGKGLEWVSYISSGSSIIYYADSVKGRFTISRDNA
KNSLYLQMNSLRAEDTAVYYCARGGELVWSPDYWGQGTLVTVSS mAb C[PD-1]_H1.130 Variable Heavy (SEQ ID NO: 572)
EVQLVESGGGLVQPGGSLRLSCAASGFTFSSFGMHWVRQAPGKGLEWVSYISSGSSIIYYADSVKGRFTISRDNA
KNSLYLQMNSLRAEDTAVYYCARGGYLVWSPDYWGQGTLVTVSS mAb C[PD-1]_H1.132 Variable Heavy (SEQ ID NO: 573)
EVQLVESGGGLVQPGGSLRLSCAASGFTFSSFGMHWVRQAPGKGLEWVSYISSGSSIIYYADSVKGRFTISRDNA
KNSLYLQMNSLRAEDTAVYYCARGGWLVWSPDYWGQGTLVTVSS mAb C[PD-1]_H1.169 Variable Heavy (SEQ ID NO: 574)
EVQLVESGGGLVQPGGSLRLSCAASGFTFSSLGMHWVRQAPGKGLEWVSYISGGSSIIYYADSVKGRFTISRDNA
KNSLYLQMNSLRAEDTAVYYCARGGRLVWSPDYWGQGTLVTVSS mAb C[PD-1]_H1.175 Variable Heavy (SEQ ID NO: 575)
EVQLVESGGGLVQPGGSLRLSCAASGFTFSSLGMHWVRQAPGKGLEWVSYISGGSSIIYYADSVKGRFTISRDNA
KNSLYLQMNSLRAEDTAVYYCARGGWLVWSPDYWGQGTLVTVSS mAb C[PD-1]_H2 Variable Heavy (SEQ ID NO: 576)
EVQLVESGGGLVKPGGSLRLSCAASGFTFSSFGMHWVRQAPGKGLEWVGYISSGSSIIYYADPVKGRFTISRDNS
KNTLYLQMNSLKTEDTAVYYCARGGRLVWSPDYWGQGTLVTVSS mAb C[PD-1]_L1 Variable Light (SEQ ID NO: 577)
DIVMTQSPDSLAVSLGERATINCKSSQSLLNSGNQKNYLTWYQQKPGQPPKLLIYWASTRESGVPDRFTGSGSGT
DFTLTISSLQAEDVAVYYCQNDYSYPFTFGSGTKLEIK mAb C[PD-1]_L1.1 Variable Light (SEQ ID NO: 578)
DIVMTQSPDSLAVSLGERATINCKSSQSLLHSGNQKNYLTWYQQKPGQPPKLLIYWASTRESGVPDRFTGSGSGT
DFTLTISSLQAEDVAVYYCQNDYSYPFTFGSGTKLEIK mAb C[PD-1]_L1.3 Variable Light (SEQ ID NO: 579)
DIVMTQSPDSLAVSLGERATINCKSSQSLLSSGNQKNYLTWYQQKPGQPPKLLIYWASTRESGVPDRFTGSGSGT
DFTLTISSLQAEDVAVYYCQNDYSYPFTFGSGTKLEIK

Figure 70I mAb C[PD-1]_L1.45 Variable Light (SEQ ID NO: 580)
DIVMTQSPDSLAVSLGERATINCKSSQSLLNSGNQYNYLTWYQQKPGQPPKLLIYWASTRESGVPDRFTGSGSGT
DFTLTISSLQAEDVAVYYCQNDYSYPFTFGSGTKLEIK mAb C[PD-1]_L1.117 Variable Light (SEQ ID NO: 581)
DIVMTQSPDSLAVSLGERATINCKSSQSLLNSGNQKNYLTWYQQKPGQPPKLLIYWASTRESGVPDRFTGSGSGT
DFTLTISSLQAEDVAVYYCQNDYTYPFTFGSGTKLEIK mAb C[PD-1]_L1.129 Variable Light (SEQ ID NO: 582)
DIVMTQSPDSLAVSLGERATINCKSSQSLLNSGNQKNYLTWYQQKPGQPPKLLIYWASTRESGVPDRFTGSGSGT
DFTLTISSLQAEDVAVYYCQNDYSWPFTFGSGTKLEIK mAb C[PD-1]_L1.135 Variable Light (SEQ ID NO: 583)
DIVMTQSPDSLAVSLGERATINCKSSQSLLHSGNQYNYLTWYQQKPGQPPKLLIYWASTRESGVPDRFTGSGSGT
DFTLTISSLQAEDVAVYYCQNDYSYPFTFGSGTKLEIK mAb C[PD-1]_L1.136 Variable Light (SEQ ID NO: 584)
DIVMTQSPDSLAVSLGERATINCKSSQSLLHSGNQKNYLTWYQQKPGQPPKLLIYWASTRESGVPDRFTGSGSGT
DFTLTISSLQAEDVAVYYCQNDYTYPFTFGSGTKLEIK mAb C[PD-1]_L1.140 Variable Light (SEQ ID NO: 585)
DIVMTQSPDSLAVSLGERATINCKSSQSLLHSGNQYNYLTWYQQKPGQPPKLLIYWASTRESGVPDRFTGSGSGT
DFTLTISSLQAEDVAVYYCQNDYTYPFTFGSGTKLEIK mAb C[PD-1]_L2 Variable Light (SEQ ID NO: 586)
DIVMTQSPLSLPVTPGEPASISCRSSQSLLNSGNQKNYLTWYLQKPGQPPQLLIYWASTRESGVPDRFTGSGSGT
DFTLKISRVEAEDVGVYYCQNDYSYPFTFGSGTKLEIK

Figure 71

>XENP021575 1C11[PD-1]_H0L0_IgG1_PVA_/S267K Heavy Chain (SEQ ID NO: 587)
QIQLVQSGPELKKPGETVKISCRASGYTFTHYGMNWVKQAPGKGLKWMGWINTYTGEPTYADDFKGRFAFSLETSASTAYLQINNLKNED
TATYFCARDYYGSSPYWGQGTTLTVSS/ASTKGPSVFPLAPSSKSTSGGTAALGCLVKDYFPEPVTVSWNSGALTSGVHTFPAVLQSSGL
YSLSSVVTVPSSSLGTQTYICNVNHKPSNTKVDKKVEPKSCDKTHTCPPCPAPPVAGPSVFLFPPKPKDTLMISRTPEVTCVVVDVKHED
PEVKFNWYVDGVEVHNAKTKPREEQYNSTYRVVSVLTVLHQDWLNGKEYKCKVSNKALPAPIEKTISKAKGQPREPQVYTLPPSREEMTK
NQVSLTCLVKGFYPSDIAVEWESNGQPENNYKTTPPVLDSDGSFFLYSKLTVDKSRWQQGNVFSCSVMHEALHNHYTQKSLSLSPGK

>XENP021575 1C11[PD-1]_H0L0_IgG1_PVA_/S267K Light Chain (SEQ ID NO: 588)
DVLMTQTPLSLPVSLGDQASISCRSSQSIVHSNGNTYLEWYLQKPGQSPKLLIYKVSNRFSGVPDRFSGSGSGTDFTLKISRVEAEDLGV
YYCFQGSHVPNTFGGGTKLEIK/RTVAAPSVFIFPPSDEQLKSGTASVVCLLNNFYPREAKVQWKVDNALQSGNSQESVTEQDSKDSTYS
LSSTLTLSKADYEKHKVYACEVTHQGLSSPVTKSFNRGEC

>XENP022553 1C11[PD-1]_H3L3_IgG1_PVA_/S267K Heavy Chain (SEQ ID NO: 589)
QIQLVQSGSELKKPGASVKVSCKASGYTFTHYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK

>XENP022553 1C11[PD-1]_H3L3_IgG1_PVA_/S267K Light Chain (SEQ ID NO: 590)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC

Figure 72

>XENP28519 mAb A[PD-1]_H1L1_IgG1_PVA_/S267K

XENP28519 Chain 1 - mAb A[PD-1]_H1_IgG1_PVA_/S267K Heavy Chain (SEQ ID NO: 591)
QVQLQESGPGLVKPSQTLSLTCTVSGHSITSDYAWNWIRQPPGKKLEWIGYISYSGYTTYNPSLKSRVTISRDTS
KNQFSLKLSSVTAADTAVYFCARDLDYGPWFAYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNHYTQKSLSLSPGK XENP28519 Chain 2 - mAb A[PD-1]_L1 Light Chain (SEQ ID NO: 592)
DIQMTQSPSSLSASVGDRVTITCRASENIHNYLAWYQQKPGKSPKLLVYNVKTLADGVPSRFSGSGSGTDYTLTI
SSLQPEDFATYYCQHFWSSPWTFGGGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC >XENP28686 mAb B[PD-1]_H1L1_IgG1_PVA_/S267K XENP28686 Chain 1 - mAb B[PD-1]_H1_IgG1_PVA_/S267K Heavy Chain (SEQ ID NO: 593)
QVQLVQSGAEVKKPGASVKVSCKASGYTFTNFYIHWVRQAPGQSIEWMGSIYPNYGDTAYNQKFQGRVTMTVDKS
ISTAYMELSRLRSDDTAVYYCARGYSYAMDYWGQGTTVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREEMTKNQVSLTCLVKGFYPS
DIAVEWESNGQPENNYKTTPPVLDSDGSFFLYSKLTVDKSRWQQGNVFSCSVMHEALHNHYTQKSLSLSPGK XENP28686 Chain 2 - mAb B[PD-1]_L1 Light Chain (SEQ ID NO: 594)
DIQMTQSPSSLSASVGDRVTITCRASQGISGDLNWYQQKPGKTVKLLIYHTSSLHSGVPLRFSGSGSGTDYTLTI
SSLQPEDFATYYCQYYSKDLLTFGAGTKLEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC >XENP28536 mAb C[PD-1]_H1L1_IgG1_PVA_/S267K XENP28536 Chain 1 - mAb C[PD-1]_H1_IgG1_PVA_/S267K Heavy Chain (SEQ ID NO: 595)
EVQLVESGGGLVQPGGSLRLSCAASGFTFSSFGMHWVRQAPGKGLEWVSYISSGSSIIYYADSVKGRFTISRDNA
KNSLYLQMNSLRAEDTAVYYCARGGRLVWSPDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREEMTKNQVSLTCLVKGFY
PSDIAVEWESNGQPENNYKTTPPVLDSDGSFFLYSKLTVDKSRWQQGNVFSCSVMHEALHNHYTQKSLSLSPGK XENP28536 Chain 2 - mAb C[PD-1]_L1 Light Chain (SEQ ID NO: 596)
DIVMTQSPDSLAVSLGERATINCKSSQSLLNSGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

Figure 73

|  | XENP16432 | XENP21461 | 1C11-based mAb | chmAb A | chmAb B | chmAb C | PDL1-Fc |
|---|---|---|---|---|---|---|---|
| XENP16432 | 0.0468 | 0.0143 | 0.2899 | 0.9692 | 0.9299 | 0.9248 | 0.1582 |
| XENP21461 | 0.0816 | 0.0301 | 0.405 | 0.8851 | 0.8542 | 0.8414 | 0.1585 |
| 1C11-based mAb | -0.068 | 0.392 | 0.0987 | 0.8468 | 0.098 | 0.0106 | -0.0232 |
| chmAb A | 1.0095 | 1.0145 | 0.9657 | 0.0141 | 0.0157 | 0.0237 | 0.5737 |
| chmAb B | 0.8889 | 0.9079 | 0.253 | 0.0372 | 0.0372 | 0.0161 | 0.2058 |
| chmAb C | 0.8851 | 0.9078 | 0.8546 | 0.0368 | 0.0237 | 0.0222 | 0.3376 |
| HBS-EP | 1 | 1 | 1 | 1 | 1 | 1 | 1 |
| PDL1-Fc | 0.5418 | 0.5045 | 0.6211 | 0.9274 | 0.9142 | 0.9341 | 0.3162 |

Figure 75A

| mAb C(PD-1) Variant Description | Substitution (Xencor #) | Kabat Position | $K_D$ (M) | $k_a$ (1/Ms) | $k_d$ (1/s) | Fold improvement over WT |
|---|---|---|---|---|---|---|
| H1L1 | WT | | 3.82E-08 | 1.12E+05 | 4.28E-03 | 1.00 |
| H1.1_L1 | In VH | | 3.21E-08 | 1.27E+05 | 4.07E-03 | 1.19 |
| H1.2_L1 | In VH | | 3.56E-08 | 1.21E+05 | 4.32E-03 | 1.07 |
| H1.3_L1 | In VH | | 4.00E-08 | 1.18E+05 | 4.72E-03 | 0.96 |
| H1.4_L1 | In VH | | 3.40E-08 | 1.24E+05 | 4.22E-03 | 1.12 |
| H1.5_L1 | In VH | | 3.74E-08 | 1.27E+05 | 4.75E-03 | 1.02 |
| H1.6_L1 | In VH | | 4.85E-08 | 1.09E+05 | 5.29E-03 | 0.79 |
| H1.7_L1 | In VH | | 5.25E-08 | 1.04E+05 | 5.45E-03 | 0.73 |
| H1.8_L1 | In VH | | 5.13E-08 | 1.04E+05 | 5.34E-03 | 0.74 |
| H1.9_L1 | In VH | | 4.69E-08 | 1.21E+05 | 5.67E-03 | 0.81 |
| H1.10_L1 | In VH | | 3.69E-08 | 1.15E+05 | 4.25E-03 | 1.03 |
| H1.11_L1 | In VH | | 3.68E-08 | 1.23E+05 | 4.54E-03 | 1.04 |
| H1.12_L1 | In VH | | 4.42E-08 | 1.22E+05 | 5.37E-03 | 0.87 |
| H1.13_L1 | In VH | | 5.02E-08 | 1.26E+05 | 6.34E-03 | 0.76 |
| H1.14_L1 | In VH | | 4.58E-08 | 1.19E+05 | 5.46E-03 | 0.83 |
| H1.15_L1 | In VH | | 4.00E-08 | 1.39E+05 | 5.57E-03 | 0.95 |
| H1.16_L1 | In VH | | 4.71E-08 | 1.09E+05 | 5.14E-03 | 0.81 |
| H1.17_L1 | In VH | | 5.04E-08 | 1.06E+05 | 5.34E-03 | 0.76 |
| H1.18_L1 | In VH | | 4.79E-08 | 1.25E+05 | 5.97E-03 | 0.80 |
| H1.19_L1 | VH-F34L | 32 | 1.67E-08 | 1.30E+05 | 2.17E-03 | 2.29 |
| H1.20_L1 | In VH | | 1.62E-07 | 1.26E+05 | 2.04E-02 | 0.24 |
| H1.21_L1 | In VH | | 2.72E-08 | 1.37E+05 | 3.71E-03 | 1.41 |
| H1.22_L1 | In VH | | 3.40E-08 | 1.05E+05 | 3.58E-03 | 1.12 |
| H1.23_L1 | In VH | | 7.34E-08 | 1.18E+05 | 8.63E-03 | 0.52 |
| H1.24_L1 | In VH | | 5.49E-08 | 1.25E+05 | 6.88E-03 | 0.70 |
| H1.25_L1 | In VH | | 1.13E-07 | 1.07E+05 | 1.20E-02 | 0.34 |
| H1.26_L1 | In VH | | 1.93E-07 | 1.87E+05 | 3.60E-02 | 0.20 |
| H1.27_L1 | In VH | | 1.04E-07 | 1.37E+05 | 1.42E-02 | 0.37 |
| H1.28_L1 | In VH | | 9.27E-08 | 3.01E+05 | 2.79E-02 | 0.41 |
| H1.29_L1 | In VH | | 2.23E-07 | 1.96E+05 | 4.37E-02 | 0.17 |
| H1.30_L1 | In VH | | 7.64E-08 | 3.37E+05 | 2.57E-02 | 0.50 |
| H1.31_L1 | In VH | | 5.64E-08 | 7.11E+05 | 4.01E-02 | 0.68 |
| H1.32_L1 | In VH | | N/A | | | N/A |
| H1.33_L1 | In VH | | N/A | | | N/A |
| H1.34_L1 | In VH | | N/A | | | N/A |
| H1.35_L1 | In VH | | N/A | | | N/A |
| H1.36_L1 | In VH | | 3.74E-07 | 1.23E+05 | 4.60E-02 | 0.10 |

Figure 75B

| mAb C[PD-1] Variant Description | Substitution (Xencor #) | Kabat Position | K_D (M) | k_a (1/Ms) | k_d (1/s) | Fold improvement over WT |
|---|---|---|---|---|---|---|
| H1.37_L1 | in VH | | 5.60E-08 | 1.36E+05 | 7.63E-03 | 0.68 |
| H1.38_L1 | in VH | | 5.75E-08 | 1.35E+05 | 7.76E-03 | 0.66 |
| H1.39_L1 | in VH | | 1.15E-07 | 1.54E+05 | 1.78E-02 | 0.33 |
| H1.40_L1 | in VH | | 2.31E-07 | 1.27E+05 | 2.93E-02 | 0.17 |
| H1.41_L1 | in VH | | 7.46E-08 | 1.40E+05 | 1.04E-02 | 0.51 |
| H1.42_L1 | in VH | | 5.00E-07 | 5.30E+04 | 2.65E-02 | 0.08 |
| H1.43_L1 | in VH | | 6.65E-07 | 2.23E+05 | 1.48E-01 | 0.06 |
| H1.44_L1 | in VH | | 1.83E-07 | 1.23E+05 | 2.25E-02 | 0.21 |
| H1.45_L1 | in VH | | 7.45E-08 | 1.22E+05 | 9.10E-03 | 0.51 |
| H1.46_L1 | in VH | | 4.19E-08 | 1.26E+05 | 5.29E-03 | 0.91 |
| H1.47_L1 | in VH | | 1.17E-07 | 1.36E+05 | 1.59E-02 | 0.33 |
| H1.48_L1 | VH-S55G | 52A | 2.01E-08 | 1.46E+05 | 2.93E-03 | 1.90 |
| H1.49_L1 | in VH | | 9.28E-08 | 1.47E+05 | 1.36E-02 | 0.41 |
| H1.50_L1 | in VH | | 2.42E-08 | 1.19E+05 | 2.87E-03 | 1.58 |
| H1.51_L1 | in VH | | 5.49E-08 | 1.03E+05 | 5.67E-03 | 0.70 |
| H1.52_L1 | in VH | | 3.31E-08 | 1.28E+05 | 4.23E-03 | 1.15 |
| H1.53_L1 | in VH | | 9.60E-08 | 2.95E+05 | 2.83E-02 | 0.40 |
| H1.54_L1 | in VH | | 3.45E-08 | 1.25E+05 | 4.32E-03 | 1.11 |
| H1.55_L1 | in VH | | 3.39E-08 | 1.35E+05 | 4.57E-03 | 1.13 |
| H1.56_L1 | in VH | | 3.15E-08 | 1.29E+05 | 4.07E-03 | 1.21 |
| H1.57_L1 | in VH | | 3.09E-08 | 1.50E+05 | 4.64E-03 | 1.24 |
| H1.58_L1 | in VH | | 4.39E-08 | 1.24E+05 | 5.44E-03 | 0.87 |
| H1.59_L1 | in VH | | 3.76E-08 | 1.31E+05 | 4.94E-03 | 1.02 |
| H1.60_L1 | in VH | | 3.59E-08 | 1.28E+05 | 4.58E-03 | 1.06 |
| H1.61_L1 | in VH | | 4.15E-08 | 1.38E+05 | 5.74E-03 | 0.92 |
| H1.62_L1 | in VH | | 5.99E-08 | 1.29E+05 | 7.74E-03 | 0.64 |
| H1.63_L1 | in VH | | 4.24E-08 | 1.46E+05 | 6.19E-03 | 0.90 |
| H1.64_L1 | in VH | | 5.91E-08 | 1.32E+05 | 7.83E-03 | 0.65 |
| H1.65_L1 | in VH | | 6.10E-08 | 1.36E+05 | 8.27E-03 | 0.63 |
| H1.66_L1 | in VH | | 1.12E-07 | 1.15E+05 | 1.29E-02 | 0.34 |
| H1.67_L1 | in VH | | 4.92E-08 | 1.41E+05 | 6.92E-03 | 0.78 |
| H1.68_L1 | in VH | | 7.40E-08 | 1.09E+05 | 8.08E-03 | 0.52 |
| H1.69_L1 | in VH | | 5.96E-08 | 1.37E+05 | 8.18E-03 | 0.64 |
| H1.70_L1 | in VH | | 4.80E-08 | 1.40E+05 | 6.74E-03 | 0.80 |
| H1.71_L1 | in VH | | 4.58E-08 | 1.10E+05 | 5.05E-03 | 0.83 |
| H1.72_L1 | in VH | | 6.247E-08 | 1.12E+05 | 7.01E-03 | 0.61 |
| H1L1 | WT | | 4.07E-08 | 1.49E+05 | 6.05E-03 | 1.00 |

Figure 75C

| mAb C(PD-1) Variant Description | Substitution (Xencor #) | Kabat Position | $K_D$ (M) | $k_a$ (1/Ms) | $k_d$ (1/s) | Fold improvement over WT |
|---|---|---|---|---|---|---|
| H1.73_L1 | in VH |  | 2.827E-08 | 1.30E+05 | 3.67E-03 | 1.44 |
| H1.74_L1 | in VH |  | 5.701E-08 | 1.65E+05 | 9.40E-03 | 0.71 |
| H1.75_L1 | in VH |  | 5.258E-08 | 1.52E+05 | 8.01E-03 | 0.77 |
| H1.76_L1 | in VH |  | 5.088E-08 | 1.50E+05 | 7.61E-03 | 0.80 |
| H1.77_L1 | in VH |  | 3.59E-08 | 1.52E+05 | 5.46E-03 | 1.13 |
| H1.78_L1 | in VH |  | 1.744E-07 | 1.34E+05 | 2.33E-02 | 0.23 |
| H1.79_L1 | in VH |  | 4.342E-08 | 1.58E+05 | 6.86E-03 | 0.94 |
| H1.80_L1 | in VH |  | 2.066E-07 | 2.26E+05 | 4.66E-02 | 0.20 |
| H1.81_L1 | in VH |  | N/A |  |  | N/A |
| H1.82_L1 | in VH |  | N/A |  |  | N/A |
| H1.83_L1 | in VH |  | N/A |  |  | N/A |
| H1.84_L1 | in VH |  | N/A |  |  | N/A |
| H1.85_L1 | in VH |  | 1.323E-07 | 4.67E+05 | 6.18E-02 | 0.31 |
| H1.86_L1 | in VH |  | N/A |  |  | N/A |
| H1.87_L1 | in VH |  | N/A |  |  | N/A |
| H1.88_L1 | in VH |  | N/A |  |  | N/A |
| H1.89_L1 | in VH |  | 4.317E-08 | 1.55E+05 | 6.69E-03 | 0.94 |
| H1.90_L1 | in VH |  | 5.149E-08 | 1.41E+05 | 7.27E-03 | 0.79 |
| H1.91_L1 | in VH |  | 6.1E-08 | 1.50E+05 | 9.17E-03 | 0.67 |
| H1.92_L1 | in VH |  | 4.777E-08 | 1.78E+05 | 8.51E-03 | 0.85 |
| H1.93_L1 | in VH |  | 3.104E-08 | 1.70E+05 | 5.28E-03 | 1.31 |
| H1.94_L1 | in VH |  | 8.06E-08 | 2.00E+05 | 1.61E-02 | 0.50 |
| H1.95_L1 | in VH |  | 7.339E-08 | 1.62E+05 | 1.19E-02 | 0.55 |
| H1.96_L1 | in VH |  | 4.157E-08 | 1.81E+05 | 7.51E-03 | 0.98 |
| H1.97_L1 | in VH |  | 1.135E-07 | 1.54E+05 | 1.75E-02 | 0.36 |
| H1.98_L1 | in VH |  | N/A |  |  | N/A |
| H1.99_L1 | in VH |  | 2.609E-07 | 2.50E+05 | 6.51E-02 | 0.16 |
| H1.100_L1 | in VH |  | N/A |  |  | N/A |
| H1.101_L1 | in VH |  | N/A |  |  | N/A |
| H1.102_L1 | in VH |  | N/A |  |  | N/A |
| H1.103_L1 | in VH |  | N/A |  |  | N/A |
| H1.104_L1 | in VH |  | 4.113E-07 | 1.24E+06 | 5.11E-01 | 0.10 |
| H1.105_L1 | in VH |  | 5.102E-07 | 4.97E+05 | 2.54E-01 | 0.08 |
| H1.106_L1 | in VH |  | N/A |  |  | N/A |
| H1.107_L1 | in VH |  | N/A |  |  | N/A |
| H1.108_L1 | in VH |  | 2.066E-07 | 1.70E+05 | 3.51E-02 | 0.20 |
| H1.109_L1 | in VH |  | N/A |  |  | N/A |

Figure 75D

| mAb C[PD-1] Variant Description | Substitution (Xencor #) | Kabat Position | $K_D$ (M) | $k_a$ (1/Ms) | $k_d$ (1/s) | Fold improvement over WT |
|---|---|---|---|---|---|---|
| H1.110_L1 | In VH | | N/A | | | N/A |
| H1.111_L1 | In VH | | N/A | | | N/A |
| H1.112_L1 | In VH | | N/A | | | N/A |
| H1.113_L1 | In VH | | N/A | | | N/A |
| H1.114_L1 | In VH | | 5.919E-07 | 1.48E+05 | 8.75E-02 | 0.07 |
| H1.115_L1 | In VH | | 7.674E-08 | 1.51E+05 | 1.16E-02 | 0.53 |
| H1.116_L1 | In VH | | 1.832E-07 | 1.90E+05 | 3.47E-02 | 0.22 |
| H1.117_L1 | In VH | | 1.207E-07 | 8.69E+04 | 1.05E-02 | 0.34 |
| H1.118_L1 | In VH | | 1.924E-07 | 1.64E+05 | 3.16E-02 | 0.21 |
| H1.119_L1 | In VH | | 1.861E-07 | 2.02E+05 | 3.76E-02 | 0.22 |
| H1.120_L1 | In VH | | N/A | | | N/A |
| H1.121_L1 | In VH | | N/A | | | N/A |
| H1.122_L1 | In VH | | N/A | | | N/A |
| H1.123_L1 | In VH | | 3.501E-07 | 1.54E+05 | 5.38E-02 | 0.12 |
| H1.124_L1 | In VH | | 4.88E-08 | 1.38E+05 | 6.74E-03 | 0.83 |
| H1.125_L1 | VH-R109E | 97 | 1.872E-08 | 2.78E+05 | 5.20E-03 | 2.17 |
| H1.126_L1 | In VH | | 4.308E-08 | 2.54E+05 | 1.09E-02 | 0.94 |
| H1.127_L1 | In VH | | 3.082E-08 | 1.88E+05 | 5.78E-03 | 1.32 |
| H1.128_L1 | In VH | | 3.275E-08 | 1.86E+05 | 6.08E-03 | 1.24 |
| H1.129_L1 | In VH | | 4.319E-08 | 1.67E+05 | 7.19E-03 | 0.94 |
| H1.130_L1 | VH-R109Y | 97 | 2.215E-08 | 2.28E+05 | 5.05E-03 | 1.84 |
| H1.131_L1 | In VH | | 4.353E-08 | 2.02E+05 | 8.78E-03 | 0.93 |
| H1.132_L1 | VH-R109W | 97 | 9.631E-09 | 2.27E+05 | 2.18E-03 | 4.23 |
| H1.133_L1 | In VH | | 4.947E-08 | 1.52E+05 | 7.53E-03 | 0.82 |
| H1.134_L1 | In VH | | 6.079E-08 | 1.45E+05 | 8.80E-03 | 0.67 |
| H1.135_L1 | In VH | | 4.669E-08 | 1.47E+05 | 6.85E-03 | 0.87 |
| H1.136_L1 | In VH | | 5.45E-08 | 1.58E+05 | 8.63E-03 | 0.75 |
| H1.137_L1 | In VH | | 3.264E-08 | 1.72E+05 | 5.60E-03 | 1.25 |
| H1.138_L1 | In VH | | 1.162E-07 | 1.10E+05 | 1.28E-02 | 0.35 |
| H1.139_L1 | In VH | | 9.894E-08 | 1.11E+05 | 1.10E-02 | 0.41 |
| H1.140_L1 | In VH | | N/A | | | N/A |
| H1.141_L1 | In VH | | 1.175E-07 | 1.12E+05 | 1.32E-02 | 0.35 |
| H1.142_L1 | In VH | | 8.796E-08 | 1.34E+05 | 1.18E-02 | 0.46 |
| H1.143_L1 | In VH | | 3.561E-08 | 1.78E+05 | 6.33E-03 | 1.14 |
| H1.144_L1 | In VH | | 1.301E-07 | 1.34E+05 | 1.74E-02 | 0.31 |
| H1.145_L1 | In VH | | 1.099E-07 | 1.61E+05 | 1.77E-02 | 0.37 |
| H1.146_L1 | In VH | | 1.015E-07 | 1.55E+05 | 1.57E-02 | 0.40 |

Figure 75E

| mAb C[PD-1] Variant Description | Substitution (Xencor #) | Kabat Position | $K_D$ (M) | $k_a$ (1/Ms) | $k_d$ (1/s) | Fold improvement over WT |
|---|---|---|---|---|---|---|
| H1.147_L1 | In VH | | 9.234E-08 | 1.40E+05 | 1.30E-02 | 0.44 |
| H1.148_L1 | In VH | | 7.755E-08 | 1.44E+05 | 1.12E-02 | 0.52 |
| H1.149_L1 | In VH | | 1.163E-07 | 9.97E+04 | 1.16E-02 | 0.35 |
| H1.150_L1 | In VH | | 6.001E-08 | 8.72E+04 | 5.24E-03 | 0.68 |
| H1.151_L1 | In VH | | 3.09E-07 | 2.82E+05 | 8.70E-02 | 0.13 |
| H1.152_L1 | In VH | | 3.01E-07 | 3.26E+05 | 9.81E-02 | 0.14 |
| H1.153_L1 | In VH | | N/A | | | N/A |
| H1.154_L1 | In VH | | N/A | | | N/A |
| H1.155_L1 | In VH | | N/A | | | N/A |
| H1.156_L1 | In VH | | N/A | | | N/A |
| H1.157_L1 | In VH | | N/A | | | N/A |
| H1.158_L1 | In VH | | N/A | | | N/A |
| H1.159_L1 | In VH | | N/A | | | N/A |
| H1.160_L1 | In VH | | 9.068E-08 | 8.43E+04 | 7.64E-03 | 0.45 |
| H1.161_L1 | In VH | | 4.753E-08 | 1.59E+05 | 7.55E-03 | 0.86 |
| H1.162_L1 | In VH | | N/A | | | N/A |
| H1.163_L1 | In VH | | 9.196E-08 | 1.23E+05 | 1.13E-02 | 0.44 |
| H1.164_L1 | In VH | | 2.8E-07 | 5.94E+04 | 1.66E-02 | 0.15 |
| H1.165_L1 | In VH | | N/A | | | N/A |
| H1.166_L1 | In VH | | 1.888E-07 | 2.42E+05 | 4.57E-02 | 0.22 |
| H1.167_L1 | In VH | | N/A | | | N/A |
| H1.168_L1 | In VH | | N/A | | | N/A |
| H1_L1.1 | VL-N31H | 27D | 5.464E-09 | 9.73E+04 | 5.32E-04 | 7.45 |
| H1_L1.2 | In VL | | 1.519E-07 | 1.50E+05 | 2.28E-02 | 0.27 |
| H1_L1.3 | VL-N31S | 27D | 1.083E-08 | 1.53E+05 | 1.65E-03 | 3.76 |
| H1_L1.4 | In VL | | N/A | | | N/A |
| H1_L1.5 | In VL | | 3.294E-08 | 1.73E+05 | 5.69E-03 | 1.24 |
| H1_L1.6 | In VL | | 6.46E-08 | 1.20E+05 | 7.77E-03 | 0.63 |
| H1_L1.7 | In VL | | 8.462E-08 | 1.03E+05 | 8.75E-03 | 0.48 |
| H1_L1.8 | In VL | | 3.069E-07 | 8.06E+04 | 2.47E-02 | 0.13 |
| H1_L1.9 | In VL | | 4.666E-08 | 1.07E+05 | 5.00E-03 | 0.87 |
| H1_L1.10 | In VL | | 8.287E-08 | 9.10E+04 | 7.55E-03 | 0.49 |
| H1_L1.11 | In VL | | 1.033E-07 | 9.65E+04 | 9.97E-03 | 0.39 |
| H1_L1.12 | In VL | | 1.108E-07 | 1.04E+05 | 1.15E-02 | 0.37 |
| H1_L1.13 | In VL | | 1.033E-07 | 1.02E+05 | 1.06E-02 | 0.39 |
| H1_L1.14 | In VL | | 1.696E-07 | 8.32E+04 | 1.41E-02 | 0.24 |
| H1_L1.15 | In VL | | 1.073E-07 | 9.08E+04 | 9.75E-03 | 0.38 |

Figure 75F

| mAb C[PD-1] Variant Description | Substitution (Xencor #) | Kabat Position | $K_D$ (M) | $k_a$ (1/Ms) | $k_d$ (1/s) | Fold improvement over WT |
|---|---|---|---|---|---|---|
| H1_L1.16 | In VL | | 1.289E-07 | 1.02E+05 | 1.32E-02 | 0.32 |
| H1_L1.17 | In VL | | 1.81E-07 | 1.29E+05 | 2.34E-02 | 0.22 |
| H1_L1.18 | In VL | | 2.05E-07 | 1.23E+05 | 2.52E-02 | 0.20 |
| H1_L1.19 | In VL | | 2.059E-07 | 1.43E+05 | 2.95E-02 | 0.20 |
| H1_L1.20 | In VL | | 7.311E-08 | 1.84E+05 | 1.34E-02 | 0.56 |
| H1_L1.21 | In VL | | 3.566E-07 | 1.39E+05 | 4.95E-02 | 0.11 |
| H1_L1.22 | In VL | | 2.714E-07 | 9.91E+04 | 2.69E-02 | 0.15 |
| H1_L1.23 | In VL | | 5.763E-08 | 1.04E+05 | 6.00E-03 | 0.71 |
| H1_L1.24 | In VL | | 1.998E-07 | 9.16E+04 | 1.83E-02 | 0.20 |
| H1_L1.25 | In VL | | 1.521E-07 | 8.09E+04 | 1.23E-02 | 0.27 |
| H1_L1.26 | In VL | | 1.771E-07 | 1.30E+05 | 2.29E-02 | 0.23 |
| H1_L1.27 | In VL | | 5.155E-08 | 2.27E+05 | 1.17E-02 | 0.79 |
| H1_L1.28 | In VL | | 4.032E-07 | 1.34E+05 | 5.39E-02 | 0.10 |
| H1_L1.29 | In VL | | 3.051E-07 | 1.33E+05 | 4.05E-02 | 0.13 |
| H1_L1.30 | In VL | | 6.186E-08 | 1.46E+05 | 9.01E-03 | 0.66 |
| H1_L1.31 | In VL | | N/A | | | N/A |
| H1_L1.32 | In VL | | 3.503E-08 | 1.36E+05 | 4.76E-03 | 1.16 |
| H1_L1.33 | In VL | | 4.268E-08 | 1.33E+05 | 5.66E-03 | 0.95 |
| H1_L1.34 | In VL | | 4.209E-08 | 1.07E+05 | 4.51E-03 | 0.97 |
| H1_L1.35 | In VL | | 5.757E-08 | 1.11E+05 | 6.38E-03 | 0.71 |
| H1_L1.36 | In VL | | 6.091E-08 | 1.11E+05 | 6.78E-03 | 0.67 |
| H1_L1.37 | In VL | | 2.898E-08 | 1.26E+05 | 3.64E-03 | 1.40 |
| H1_L1.38 | In VL | | 3.049E-08 | 1.44E+05 | 4.39E-03 | 1.33 |
| H1_L1.39 | In VL | | 5.45E-08 | 1.09E+05 | 5.96E-03 | 0.75 |
| H1_L1.40 | In VL | | 3.806E-08 | 1.20E+05 | 4.55E-03 | 1.07 |
| H1_L1.41 | In VL | | 3.967E-08 | 1.28E+05 | 5.08E-03 | 1.03 |
| H1_L1.42 | In VL | | 3.653E-08 | 1.34E+05 | 4.90E-03 | 1.11 |
| H1_L1.43 | In VL | | 3.98E-08 | 1.37E+05 | 5.46E-03 | 1.02 |
| H1_L1.44 | In VL | | 1.995E-08 | 1.46E+05 | 2.91E-03 | 2.04 |
| H1_L1.45 | VL-K36Y | 30 | 8.602E-09 | 1.57E+05 | 1.35E-03 | 4.73 |
| H1_L1.46 | In VL | | 2.637E-08 | 1.23E+05 | 3.24E-03 | 1.54 |
| H1_L1.47 | In VL | | 2.375E-08 | 1.49E+05 | 3.53E-03 | 1.71 |
| H1_L1.48 | In VL | | 8.012E-08 | 9.80E+04 | 7.85E-03 | 0.51 |
| H1_L1.49 | In VL | | 6.115E-08 | 1.14E+05 | 6.97E-03 | 0.67 |
| H1_L1.50 | In VL | | 4.214E-08 | 9.71E+04 | 4.09E-03 | 0.97 |
| H1_L1.51 | In VL | | 4.259E-08 | 1.11E+05 | 4.73E-03 | 0.96 |
| H1_L1.52 | In VL | | 5.023E-08 | 1.11E+05 | 5.59E-03 | 0.81 |

Figure 75G

| mAb C[PD-1] Variant Description | Substitution (Xencor #) | Kabat Position | K$_D$ (M) | k$_a$ (1/Ms) | k$_d$ (1/s) | Fold improvement over WT |
|---|---|---|---|---|---|---|
| H1_L1.53 | in VL | | 5.181E-08 | 9.31E+04 | 4.83E-03 | 0.79 |
| H1_L1.54 | in VL | | 6.67E-08 | 1.13E+05 | 7.53E-03 | 0.61 |
| H1_L1.55 | in VL | | 8.036E-08 | 1.17E+05 | 9.42E-03 | 0.51 |
| H1_L1.56 | in VL | | 1.96E-07 | 1.31E+05 | 2.56E-02 | 0.21 |
| H1_L1.57 | in VL | | 1.569E-07 | 1.77E+05 | 2.78E-02 | 0.26 |
| H1_L1.58 | in VL | | N/A | | | N/A |
| H1_L1.59 | in VL | | N/A | | | N/A |
| H1_L1.60 | in VL | | N/A | | | N/A |
| H1_L1.61 | in VL | | N/A | | | N/A |
| H1_L1.62 | in VL | | N/A | | | N/A |
| H1_L1.63 | in VL | | N/A | | | N/A |
| H1_L1.64 | in VL | | N/A | | | N/A |
| H1_L1.65 | in VL | | 9.803E-08 | 9.68E+04 | 9.49E-03 | 0.42 |
| H1_L1.66 | in VL | | 3.527E-08 | 9.62E+04 | 3.39E-03 | 1.15 |
| H1_L1.67 | in VL | | 4.165E-08 | 1.00E+05 | 4.18E-03 | 0.98 |
| H1_L1.68 | in VL | | 1.784E-07 | 9.29E+04 | 1.66E-02 | 0.23 |
| H1_L1.69 | in VL | | 2.586E-08 | 9.44E+04 | 2.44E-03 | 1.57 |
| H1_L1.70 | in VL | | 3.091E-08 | 9.07E+04 | 2.81E-03 | 1.32 |
| H1_L1.71 | in VL | | 4.711E-08 | 9.14E+04 | 4.30E-03 | 0.86 |
| H1_L1.72 | in VL | | 6.026E-08 | 5.77E+04 | 3.48E-03 | 0.68 |
| H1_L1.73 | in VL | | 5.161E-08 | 8.81E+04 | 4.55E-03 | 0.79 |
| H1_L1.74 | in VL | | 2.646E-07 | 9.23E+04 | 2.44E-02 | 0.15 |
| H1_L1.75 | in VL | | 4.529E-08 | 1.10E+05 | 4.96E-03 | 0.90 |
| H1_L1.76 | in VL | | 5.499E-08 | 9.31E+04 | 5.12E-03 | 0.74 |
| H1_L1.77 | in VL | | 5.027E-08 | 1.06E+05 | 5.35E-03 | 0.81 |
| H1_L1.78 | in VL | | 5.679E-08 | 1.02E+05 | 5.81E-03 | 0.72 |
| H1_L1.79 | in VL | | 5.548E-08 | 1.32E+05 | 7.31E-03 | 0.73 |
| H1_L1.80 | in VL | | 5.104E-08 | 1.13E+05 | 5.78E-03 | 0.80 |
| H1_L1.81 | in VL | | 5.135E-08 | 1.18E+05 | 6.06E-03 | 0.79 |
| H1_L1.82 | in VL | | 5.261E-08 | 1.14E+05 | 6.02E-03 | 0.77 |
| H1_L1.83 | in VL | | 6.427E-08 | 9.38E+04 | 6.03E-03 | 0.63 |
| H1_L1.84 | in VL | | 4.601E-08 | 1.04E+05 | 4.78E-03 | 0.88 |
| H1_L1.85 | in VL | | 3.18E-08 | 9.94E+04 | 3.16E-03 | 1.28 |
| H1_L1.86 | in VL | | 4.06E-08 | 1.16E+05 | 4.70E-03 | 1.00 |
| H1_L1.87 | in VL | | 5.085E-08 | 1.09E+05 | 5.52E-03 | 0.80 |
| H1_L1.88 | in VL | | 4.328E-08 | 9.50E+04 | 4.11E-03 | 0.94 |
| H1_L1.89 | in VL | | 4.388E-08 | 9.19E+04 | 4.03E-03 | 0.93 |

Figure 75H

| mAb C[PD-1] Variant Description | Substitution (Xencor #) | Kabat Position | $K_D$ (M) | $k_{on}$ (1/Ms) | $k_d$ (1/s) | Fold improvement over WT |
|---|---|---|---|---|---|---|
| H1_L1.90 | in VL | | 7.882E-08 | 9.67E+04 | 7.62E-03 | 0.52 |
| H1_L1.91 | in VL | | 6.125E-08 | 8.43E+04 | 5.16E-03 | 0.66 |
| H1_L1.92 | in VL | | 5.379E-08 | 1.05E+05 | 5.62E-03 | 0.76 |
| H1_L1.93 | in VL | | 5.386E-08 | 1.03E+05 | 5.53E-03 | 0.76 |
| H1_L1.94 | in VL | | 7.002E-08 | 1.08E+05 | 7.54E-03 | 0.58 |
| H1_L1.95 | in VL | | 6.58E-08 | 1.28E+05 | 8.41E-03 | 0.62 |
| H1_L1.96 | in VL | | 3.358E-08 | 1.50E+05 | 5.04E-03 | 1.21 |
| H1_L1.97 | in VL | | 3.262E-08 | 1.32E+05 | 4.30E-03 | 1.25 |
| H1_L1.98 | in VL | | 3.387E-08 | 1.59E+05 | 5.40E-03 | 1.20 |
| H1_L1.99 | in VL | | 3.21E-08 | 1.51E+05 | 4.83E-03 | 1.27 |
| H1_L1.100 | in VL | | N/A | | | N/A |
| H1_L1.101 | in VL | | 6.962E-08 | 1.28E+05 | 8.92E-03 | 0.58 |
| H1_L1.102 | in VL | | N/A | | | N/A |
| H1_L1.103 | in VL | | N/A | | | N/A |
| H1_L1.104 | in VL | | N/A | | | N/A |
| H1_L1.105 | in VL | | N/A | | | N/A |
| H1_L1.106 | in VL | | 3.236E-07 | 2.77E+05 | 8.96E-02 | 0.13 |
| H1_L1.107 | in VL | | N/A | | | N/A |
| H1_L1.108 | in VL | | N/A | | | N/A |
| H1_L1.109 | in VL | | 6.694E-08 | 1.46E+05 | 9.78E-03 | 0.61 |
| H1_L1.110 | in VL | | 1.123E-07 | 1.52E+05 | 1.70E-02 | 0.36 |
| H1_L1.111 | in VL | | 8.078E-08 | 1.44E+05 | 1.16E-02 | 0.50 |
| H1_L1.112 | in VL | | 7.415E-08 | 1.71E+05 | 1.27E-02 | 0.55 |
| H1_L1.113 | in VL | | N/A | | | N/A |
| H1_L1.114 | in VL | | N/A | | | N/A |
| H1_L1.115 | in VL | | N/A | | | N/A |
| H1_L1.116 | in VL | | 1.533E-07 | 1.78E+05 | 2.73E-02 | 0.27 |
| H1_L1.117 | VL-S99T | 93 | 1.563E-08 | 1.61E+05 | 2.51E-03 | 2.60 |
| H1_L1.118 | in VL | | 7.512E-08 | 1.40E+05 | 1.05E-02 | 0.54 |
| H1_L1.119 | in VL | | 2.119E-08 | 1.49E+05 | 3.15E-03 | 1.92 |
| H1_L1.120 | in VL | | 6.686E-08 | 1.82E+05 | 1.22E-02 | 0.61 |
| H1_L1.121 | in VL | | 1.681E-08 | 1.43E+05 | 2.41E-03 | 2.42 |
| H1_L1.122 | in VL | | 1.501E-08 | 1.34E+05 | 2.02E-03 | 2.71 |
| H1_L1.123 | in VL | | N/A | | | N/A |
| H1_L1.124 | in VL | | 1.059E-07 | 1.43E+05 | 1.52E-02 | 0.38 |
| H1_L1.125 | in VL | | 7.62E-08 | 1.65E+05 | 1.26E-02 | 0.53 |
| H1_L1.126 | in VL | | 2.63E-08 | 1.61E+05 | 4.24E-03 | 1.55 |

Figure 75I

| mAb C[PD-1] Variant Description | Substitution (Xencor #) | Kabat Position | $K_D$ (M) | $k_a$ (1/Ms) | $k_d$ (1/s) | Fold improvement over WT |
|---|---|---|---|---|---|---|
| H1_L1.127 | In VL | | 5.552E-08 | 1.33E+05 | 7.41E-03 | 0.73 |
| H1_L1.128 | In VL | | 1.86E-07 | 4.90E+05 | 9.11E-02 | 0.22 |
| H1_L1.129 | VL-Y100W | 94 | 9.435E-09 | 1.06E+05 | 1.00E-03 | 4.31 |
| H1_L1.130 | In VL | | N/A | | | N/A |
| H1_L1.131 | In VL | | N/A | | | N/A |
| H1_L1.132 | In VL | | 3.70E-08 | 1.66E+05 | 6.15E-03 | 1.10 |
| H1_L1.133 | In VL | | 4.049E-07 | 6.51E+04 | 2.64E-02 | 0.10 |
| H1_L1.134 | In VL | | 9.13E-08 | 1.68E+05 | 1.53E-02 | 0.45 |

Figure 76A

>durvalumab[PD-L1] variable heavy Chain (SEQ ID NO: 597)
EVQLVESGGGLVQPGGSLRLSCAASGFTFSRYWMSWVRQAPGKGLEWVANIKQDGSEKYYVDSVKGRFTISRDNA
KNSLYLQMNSLRAEDTAVYYCAREGGWFGELAFDYWGQGTLVTVSS >durvalumab[PD-L1] variable light Chain (SEQ ID NO: 598)
EIVLTQSPGTLSLSPGERATLSCRASQRVSSYLAWYQQKPGQAPRLLIYDASSRATGIPDRFSGSGSGTDFTLT
ISRLEPEDFAVYYCQQYGSLPWTFGQGTKVEIK >atezolizumab[PD-L1] variable heavy Chain (SEQ ID NO: 599)
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSA >atezolizumab[PD-L1] variable light Chain (SEQ ID NO: 600)
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIKR >A09-246-2[PD-L1] variable heavy Chain (SEQ ID NO: 601)
EVQLLESGGGLVQPGGSLRLSCAASGFTFSSYIMMWVRQAPGKGLEWVSSIYPSGGITFYADTVKGRFTISRDNS
KNTLYLQMNSLRAEDTAVYYCARIKLGTVTTVDYWGQGTLVTVSS >A09-246-2[PD-L1] variable light Chain (SEQ ID NO: 602)
QSALTQPASVSGSPGQSITISCTGTSSDVGGYNYVSWYQQHPGKAPKLMIYDVSNRPSGVSNRFSGSKSGNTASL
TISGLQAEDEADYYCSSYTSSSTRVFGTGTKVTVL >12A4[PD-L1] variable heavy Chain (SEQ ID NO: 603)
QVQLVQSGAEVKKPGSSVKVSCKTSGDTFSTYAISWVRQAPGQGLEWMGGIIPIFGKAHYAQKFQGRVTITADES
TSTAYMELSSLRSEDTAVYFCARKFHFVSGSPFGMDVWGQGTTVTVSS >12A4[PD-L1] variable light Chain (SEQ ID NO: 604)
EIVLTQSPATLSLSPGERATLSCRASQSVSSYLAWYQQKPGQAPRLLIYDASNRATGIPARFSGSGSGTDFTLTI
SSLEPEDFAVYYCQQRSNWPTFGQGTKVEIK >3G10[PD-L1] variable heavy Chain (SEQ ID NO: 605)
QVQLVQSGAEVKKPGASVKVSCKASGYTFTDYGFSWVRQAPGQGLEWMGWITAYNGNTNYAQKLQGRVTMTTDTS
TSTVYMELRSLRSDDTAVYYCARDYFYGMDVWGQGTTVTVSS >3G10[PD-L1] variable light Chain (SEQ ID NO: 606)
EIVLTQSPATLSLSPGERATLSCRASQSVSSYLVWYQQKPGQAPRLLIYDASNRATGIPARFSGSGSGTDFTLTI
SSLEPEDFAVYYCQQRSNWPRTFGQGTKVEIK >10A5[PD-L1] variable heavy Chain (SEQ ID NO: 607)
QVQLVQSGAEVKKPGASVKVSCKASGYTFTSYDVHWVRQAPGQRLEWMGWLHADTGITKFSQKFQGRVTITRDTS
ASTAYMELSSLRSEDTAVYYCARERIQLWFDYWGQGTLVTVSS >10A5[PD-L1] variable light Chain (SEQ ID NO: 608)
DIQMTQSPSSLSASVGDRVTITCRASQGISSWLAWYQQKPEKAPKSLIYAASSLQSGVPSRFSGSGSGTDFTLTI
SSLQPEDFATYYCQQYNSYPYTFGQGTKLEIK >h3D10 Var 1[PD-L1] variable heavy Chain (SEQ ID NO: 609)
QVQLVQSGAEVKKPGASVKVSCKASGYTFPDYYMNWVRQAPGQGLEWMGDIDPNYGGTNYAQKFQGRVTMTRDTS
ISTAYMELSRLRSDDTAVYYCARGALTDWGQGTMVTVSS

Figure 76B

>h3D10 Var 1[PD-L1] variable light Chain (SEQ ID NO: 610)
EIVLTQSPATLSLSPGERATLSCRASSSVSYIYWFQQKPGQAPRLLIYAAFNRATGIPARFSGSGSGTDYTLTIS
SLEPEDFAVYYCQQWSNNPLTFGQGTKVEIK >h3D10 Var 2[PD-L1] variable heavy Chain (SEQ ID NO: 611)
QVQLVQSGAEVKKPGASVKVSCKASGYTFPDYYMNWVRQAPGQSLEWMGDIDPNYGGTNYNQKFQGRVTMTRDTS
ISTAYMELSRLRSDDTAVYYCARGALTDWGQGTMVTVSS >h3D10 Var 2[PD-L1] variable light Chain (SEQ ID NO: 612)
EIVLTQSPATLSLSPGERATLSCRASSSVSYIYWFQQKPGQSPRPLIYAAFNRATGIPARFSGSGSGTDYTLTIS
SLEPEDFAVYYCQQWSNNPLTFGQGTKVEIK >h3D10 Var 3[PD-L1] variable heavy Chain (SEQ ID NO: 613)
QVQLVQSGAEVKKPGASVKVSCKASGYTFPDYYMNWVRQAPGQSLEWMGDIDPNYGGTNYNQKFQGRVTMTRDTS
ISTAYMELSRLRSDDTAVYYCARGALTDWGQGTMVTVSS >h3D10 Var 3[PD-L1] variable light Chain (SEQ ID NO: 614)
QIVLTQSPATLSLSPGERATLSCRASSSVSYIYWFQQKPGQSPRPLIYATFNLASGIPARFSGSGSGTSYTLTIS
RLEPEDFAVYYCQQWSNNPLTFGQGTKVEIK >h3D10 Var 4[PD-L1] variable heavy Chain (SEQ ID NO: 615)
EVQLVQSGAEVKKPGASVKVSCKASGYTFPDYYMNWVRQAPGQSLEWMGDIDPNYGGTNYNQKFQGRVTMTVDRS
SSTAYMELSRLRSDDTAVYYCARGALTDWGQGTMVTVSS >h3D10 Var 4[PD-L1] variable light Chain (SEQ ID NO: 616)
EIVLTQSPATLSLSPGERATLSCRASSSVSYIYWFQQKPGQSPRPLIYAAFNRATGIPARFSGSGSGTDYTLTIS
SLEPEDFAVYYCQQWSNNPLTFGQGTKVEIK >h3D10 Var 5[PD-L1] variable heavy Chain (SEQ ID NO: 617)
EVQLVQSGAEVKKPGASVKVSCKASGYTFPDYYMNWVRQAPGQSLEWMGDIDPNYGGTNYNQKFQGRVTMTVDRS
SSTAYMELSRLRSDDTAVYYCARGALTDWGQGTMVTVSS >h3D10 Var 5[PD-L1] variable light Chain (SEQ ID NO: 618)
QIVLTQSPATLSLSPGERATLSCRASSSVSYIYWFQQKPGQSPRPLIYATFNLASGIPARFSGSGSGTSYTLTIS
RLEPEDFAVYYCQQWSNNPLTFGQGTKVEIK >h3D10 Var 6[PD-L1] variable heavy Chain (SEQ ID NO: 619)
EVQLVESGGGLVQPGRSLRLSCTASGYTFPDYYMNWVRQAPGKGLEWVGDIDPNYGGTTYAASVKGRFTISVDRS
KSIAYLQMSSLKTEDTAVYYCTRGALTDWGQGTMVTVSS >h3D10 Var 6[PD-L1] variable light Chain (SEQ ID NO: 620)
DIQLTQSPSSLSASVGDRVTITCRASSGVSYIYWFQQKPGKAPKLLIYAAFNLASGVPSRFSGSGSGTEYTLTIS
SLQPEDFATYYCQQWSNNPLTFGQGTKVEIK >h3D10 Var 7[PD-L1] variable heavy Chain (SEQ ID NO: 621)
EVQLVESGGGLVQPGRSLRLSCTASGYTFPDYYMNWVRQAPGKGLEWVGDIDPNYGGTTYNASVKGRFTISVDRS
KSIAYLQMSSLKTEDTAVYYCARGALTDWGQGTMVTVSS >h3D10 Var 7[PD-L1] variable light Chain (SEQ ID NO: 622)
DIQLTQSPSSLSASVGDRVTITCRASSGVSYIYWFQQKPGKAPKPLIYAAFNLASGVPSRFSGSGSGTEYTLTIS
SLQPEDFATYYCQQWSNNPLTFGQGTKVEIK

Figure 76C

>h3D10 Var 8[PD-L1] variable heavy Chain (SEQ ID NO: 623)
EVQLVESGGGLVQPGRSLRLSCTASGYTFPDYYMNWVRQAPGKGLEWVGDIDPNYGGTTYNASVKGRFTISVDRS
KSIAYLQMSSLKTEDTAVYYCARGALTDWGQGTMVTVSS >h3D10 Var 8[PD-L1] variable light Chain (SEQ ID NO: 624)
DIQLTQSPSILSASVGDRVTITCRASSSVSYIYWFQQKPGKAPKPLIYATFNLASGVPSRFSGSGSGTSYTLTIS
SLQPEDFATYYCQQWSNNPLTFGQGTKVEIK >h3D10 Var 9[PD-L1] variable heavy Chain (SEQ ID NO: 625)
EVQLVESGGGLVQPGRSLRLSCTASGYTFPDYYMNWVRQAPGKGLEWVGDIDPNYGGTTYNQSVKGRFTISVDRS
KSIAYLQMSSLKTEDTAVYYCARGALTDWGQGTMVTVSS >h3D10 Var 9[PD-L1] variable light Chain (SEQ ID NO: 626)
DIQLTQSPSSLSASVGDRVTITCRASSGVSYIYWFQQKPGKAPKPLIYAAFNLASGVPSRFSGSGSGTEYTLTIS
SLQPEDFATYYCQQWSNNPLTFGQGTKVEIK >h3D10 Var 10[PD-L1] variable heavy Chain (SEQ ID NO: 627)
EVQLVESGGGLVQPGRSLRLSCTASGYTFPDYYMNWVRQAPGKGLEWVGDIDPNYGGTTYNQSVKGRFTISVDRS
KSIAYLQMSSLKTEDTAVYYCARGALTDWGQGTMVTVSS >h3D10 Var 10[PD-L1] variable light Chain (SEQ ID NO: 628)
DIQLTQSPSILSASVGDRVTITCRASSSVSYIYWFQQKPGKAPKPLIYATFNLASGVPSRFSGSGSGTSYTLTIS
SLQPEDFATYYCQQWSNNPLTFGQGTKVEIK >h3D10 Var 11[PD-L1] variable heavy Chain (SEQ ID NO: 629)
EVQLVESGGGLVQPGRSLRLSCTASGYTFPDYYMNWVRQAPGKGLEWVGDIDPNYGGTTYAASVKGRFTISVDRS
KSIAYLQMSSLKTEDTAVYYCTRGALTDWGQGTMVTVSS >h3D10 Var 11[PD-L1] variable light Chain (SEQ ID NO: 630)
EIVLTQSPATLSLSPGERATLSCRASSSVSYIYWFQQKPGQAPRLLIYAAFNRATGIPARFSGSGSGTDYTLTIS
SLEPEDFAVYYCQQWSNNPLTFGQGTKVEIK >h3D10 Var 12[PD-L1] variable heavy Chain (SEQ ID NO: 631)
QVQLVQSGAEVKKPGASVKVSCKASGYTFPDYYMNWVRQAPGQGLEWMGDIDPNYGGTNYAQKFQGRVTMTRDTS
ISTAYMELSRLRSDDTAVYYCARGALTDWGQGTMVTVSS >h3D10 Var 12[PD-L1] variable light Chain (SEQ ID NO: 632)
DIQLTQSPSSLSASVGDRVTITCRASSGVSYIYWFQQKPGKAPKLLIYAAFNLASGVPSRFSGSGSGTEYTLTIS
SLQPEDFATYYCQQWSNNPLTFGQGTKVEIK >h3D10 Var 13[PD-L1] variable heavy Chain (SEQ ID NO: 633)
EVQLVESGGGLVQPGRSLRLSCTASGYTFPDYYMNWVRQAPGKGLEWVGDIDPNYGGTTYNQSVKGRFTISVDRS
KSIAYLQMSSLKTEDTAVYYCARGALTDWGQGTMVTVSS >h3D10 Var 13[PD-L1] variable light Chain (SEQ ID NO: 634)
QIVLTQSPATLSLSPGERATLSCRASSSVSYIYWFQQKPGQSPRPLIYATFNLASGIPARFSGSGSGTSYTLTIS
RLEPEDFAVYYCQQWSNNPLTFGQGTKVEIK >h3D10 Var 14[PD-L1] variable heavy Chain (SEQ ID NO: 635)
EVQLVQSGAEVKKPGASVKVSCKASGYTFPDYYMNWVRQAPGQSLEWMGDIDPNYGGTNYNQKFQGRVTMTVDRS
SSTAYMELSRLRSDDTAVYYCARGALTDWGQGTMVTVSS

Figure 76D

\>h3D10 Var 14[PD-L1] variable light Chain  (SEQ ID NO: 636)
DIQLTQSPSILSASVGDRVTITCRASSSVSYIYWFQQKPGKAPKPLIYATFNLASGVPSRFSGSGSGTSYTLTIS
SLQPEDFATYYCQQWSNNPLTFGQGTKVEIK \>Antibody A[PD-L1] variable heavy Chain  (SEQ ID NO: 637)
QVQLVQSGAEVKKPGSSVKVSCKASGGTFSSYAISWVRQAPGQGLEWMGGIIPIFGTANYAQKFQGRVTITADKS
TSTAYMELSSLRSEDTAVYYCARSPDYSPYYYYGMDVWGQGTTVTVSS \>Antibody A[PD-L1] variable light Chain  (SEQ ID NO: 638)
QSVLTQPPSASGTPGQRVTISCSGSSSNIGSNTVNWYQQLPGTAPKLLIYGNSNRPSGVPDRFSGSKSGTSASLA
ISGLQSEDEADYYCQSYDSSLSGSVFGGGIKLTVLG \>C5H9v2[PD-L1] variable heavy Chain  (SEQ ID NO: 639)
EVQLLESGGGLVQPGGSLRLSCAASGFTFSSYAMSWVRQAPGKGLEWVSSIWRNGIVTVYADSVKGRFTISRDNS
KNTLYLQMNSLRAEDTAVYYCAKWSAAFDYWGQGTLVTVSS \>C5H9v2[PD-L1] variable light Chain  (SEQ ID NO: 640)
DIQMTQSPSSLSASVGDRVTITCRASQSISSYLNWYQQKPGKAPKLLIYAASSLQSGVPSRFSGSGSGTDFTLTI
SSLQPEDFATYYCQQDNGYPSTFGGGTKVEIK \>humanized 29E.2A3[PD-L1] variable heavy Chain  (SEQ ID NO: 641)
EVQLVQSGAEVKKPGASVKMSCKASGYTFTSYVMHWVKQAPGQRLEWIGYVNPFNDGTKYNEMFKGRATLTSDKS
TSTAYMELSSLRSEDTAVYYCARQAWGYPWGQGTLVTVSS \>humanized 29E.2A3[PD-L1] variable light Chain  (SEQ ID NO: 642)
DIVLTQSPATLSLSPGERATLSCRATESVEYYGTSLVQWYQQKPGQPPKLLIYAASSVDSGVPSRFSGSGSGTDF
TLTINSLEAEDAATYFCQQSRRVPYTFGQGTKLEIK \>1B9[PD-L1] variable heavy Chain  (SEQ ID NO: 643)
DVQLQESGPGLVKPSQSLSLTCTVTGYSITSDHAWNWIRQVPGNKLEWMGYITYRGSTTYSPSLKSRISITRDTS
KNQFFLQLNSVTTEDTATYYCARSMITTGYYVMDYWGQGTSVTVSS \>1B9[PD-L1] variable light Chain  (SEQ ID NO: 644)
DIVMTQSHKFMSTSLGDRVTITCKASQDVGISVVWYQQKPGQSPKLLIYWASTRHTGVPDRFTGSGSGTDFTLTI
NNVQSEDLADYFCQQYSSYPLTVGAGTKLELK \>4H1[PD-L1] variable heavy Chain  (SEQ ID NO: 645)
DVQLQESGPGLVKPSQSLSLTCTVTDYSITSDYAWNWIRQFPGNKLEWMGYITYRGTTRYNPSLTSRISFTRDTS
KNQLFLQLNSVTTEDTGTYCCARSMITTGYYAMDYWGQGTSVTVSS \>4H1[PD-L1] variable light Chain  (SEQ ID NO: 646)
DIVMTQSHKFMSTSVGDRVSISCKASQDVGISVAWYQQKPGQSPKLLIYWASTRHTGVPVRFTGSGSGTDFTLTI
SNVQSEDLADYFCQQYSSYPPTFGAGTKLELK \>mAb-42[PD-L1] variable heavy Chain  (SEQ ID NO: 647)
QVQLVQSGAEVKKPGSSVKVSCKASGGTFSSYAISWVRQAPGQGLEWMGGIIPIFGTANYAQKFQGRVTITADKS
TSTAYMELSSLRSEDTAVYYCARGRQMFGAGIDFWGPGTLVTVSS \>mAb-42[PD-L1] variable light Chain  (SEQ ID NO: 648)
NFMLTQPHSVSESPGKTVTISCTRSSGSIDSNYVQWYQQRPGSAPTTVIYEDNQRPSGVPDRFSGSIDSSSNSAS
LTISGLKTEDEADYYCQSYDSNNRHVIFGGGTKLTVL

Figure 76E

>BAP058-03[PD-L1] variable heavy Chain (SEQ ID NO: 649)
EVQLVQSGAEVKKPGATVKISCKVSGYTFTSYWMYWVRQATGQGLEWMGRIDPNSGSTKYNEKFKNRVTITADKS
TSTAYMELSSLRSEDTAVYYCARDYRKGLYAMDYWGQGTTVTVSS >BAP058-03[PD-L1] variable light Chain (SEQ ID NO: 650)
EIVLTQSPDFQSVTPKEKVTITCKASQDVGTAVAWYLQKPGQSPQLLIYWASTRHTGVPDRFSGSGSGTDFTLKI
SRVEAEDVGVYYCQQYNSYPLTFGQGTKVEIK >BAP058-04[PD-L1] variable heavy Chain (SEQ ID NO: 651)
EVQLVQSGAEVKKPGESLRISCKGSGYTFTSYWMYWVRQAPGQGLEWMGRIDPNSGSTKYNEKFKNRVTISVDTS
KNQFSLKLSSVTAADTAVYYCARDYRKGLYAMDYWGQGTTVTVSS >BAP058-04[PD-L1] variable light Chain (SEQ ID NO: 652)
EIVLTQSPDFQSVTPKEKVTITCKASQDVGTAVAWYLQKPGQSPQLLIYWASTRHTGVPSRFSGSGSGTDFTFTI
SSLQPEDIATYYCQQYNSYPLTFGQGTKVEIK >BAP058-06[PD-L1] variable heavy Chain (SEQ ID NO: 653)
EVQLVQSGAEVKKPGESLRISCKGSGYTFTSYWMYWIRQPPGKGLEWIGRIDPNSGSTKYNEKFKNRVTITADKS
TSTAYMELSSLRSEDTAVYYCARDYRKGLYAMDYWGQGTTVTVSS >BAP058-06[PD-L1] variable light Chain (SEQ ID NO: 654)
EIVLTQSPDFQSVTPKEKVTITCKASQDVGTAVAWYLQKPGQSPQLLIYWASTRHTGVPSRFSGSGSGTDFTFTI
SSLQPEDIATYYCQQYNSYPLTFGQGTKVEIK >BAP058-07[PD-L1] variable heavy Chain (SEQ ID NO: 655)
QVQLVQSGAEVKKPGASVKVSCKASGYTFTSYWMYWIRQSPSRGLEWLGRIDPNSGSTKYNEKFKNRFTISRDDS
KNTAYLQMNSLKTEDTAVYYCARDYRKGLYAMDYWGQGTTVTVSS >BAP058-07[PD-L1] variable light Chain (SEQ ID NO: 656)
EIVLTQSPATLSLSPGERATLSCKASQDVGTAVAWYLQKPGQSPQLLIYWASTRHTGIPPRFSGSGYGTDFTLTI
NNIESEDAAYYFCQQYNSYPLTFGQGTKVEIK >BAP058-11[PD-L1] variable heavy Chain (SEQ ID NO: 657)
EVQLVQSGAEVKKPGATVKISCKVSGYTFTSYWMYWVRQATGQGLEWMGRIDPNSGSTKYNEKFKNRVTITADKS
TSTAYMELSSLRSEDTAVYYCARDYRKGLYAMDYWGQGTTVTVSS >BAP058-11[PD-L1] variable light Chain (SEQ ID NO: 658)
DVVMTQSPLSLPVTLGQPASISCKASQDVGTAVAWYQQKPGQAPRLLIYWASTRHTGVPSRFSGSGSGTEFTLTI
SSLQPDDFATYYCQQYNSYPLTFGQGTKVEIK >BAP058-13[PD-L1] variable heavy Chain (SEQ ID NO: 659)
EVQLVQSGAEVKKPGATVKISCKVSGYTFTSYWMYWVRQARGQRLEWIGRIDPNSGSTKYNEKFKNRFTISRDNS
KNTLYLQMNSLRAEDTAVYYCARDYRKGLYAMDYWGQGTTVTVSS >BAP058-13[PD-L1] variable light Chain (SEQ ID NO: 660)
AIQLTQSPSSLSASVGDRVTITCKASQDVGTAVAWYLQKPGQSPQLLIYWASTRHTGVPSRFSGSGSGTDFTFTI
SSLEAEDAATYYCQQYNSYPLTFGQGTKVEIK >H6[PD-L1] variable heavy Chain (SEQ ID NO: 661)
QMQLVQSGAEVKKPGSSVKVSCKASGGTFSSYAISWVRQAPGQGLEWMGGIIPIFGTANYAQKFQGRVTITADES
TSTAYMELSSLRSEDTAVYYCARGNIVATIIPLDYWGQGTLVTVSS

Figure 76F

>H6[PD-L1] variable light Chain (SEQ ID NO: 662)
SYELMQPPSVSVAPGKTATIACGGENIGRKTVHWYQQKPGQAPVLVIYYDSDRPSGIPERFSGSNSGNTATLTIS
RVEAGDEADYYCQVWDSSSDHRIFGGGTKLTVL >RC5[PD-L1] variable heavy Chain (SEQ ID NO: 663)
EVQLLESGGGVVQPGGSLRLSCAASGFTFSSYWMSWVRQAPGKGLEWVANIKQDGSEKYYVDSVKGRFTISRDNS
KNTVSLQMNSLRAEDTAVYYCAKDRYYNFFLGMDVWGQGTTVTVSS >RC5[PD-L1] variable light Chain (SEQ ID NO: 664)
AIRMTQSPSSLSASVGDRVTITCRASQSISSYLNWYQQKPGKAPKLLIYTTSSLKSGVPSRFSGSGSGTDFTLTI
SRLQPEDFATYYCQQSYSSTWTFGRGTKVEIK >SH1A1Q[PD-L1] variable heavy Chain (SEQ ID NO: 665)
EVQLVQSGAEVKKPGSSVKVSCKASGGTFSSYAISWVRQAPGQGLEWMGGIIPIFGTANYAQKFQGRVTITADKS
TSTAYMELSSLRSEDTAVYYCAREGTIYDSSGYSFDYWGQGTLVTVSS >SH1A1Q[PD-L1] variable light Chain (SEQ ID NO: 666)
QSVLTQPPSVSAAPGQKVTISCSGNNSNIANNYVSWYQQLPGTAPKLLIYDNNYRPSGIPDRFSGSKSGTSATLD
ITGLQTGDEADYYCGVWDGSLTTGVFGGGTKLTVL >SH1B3[PD-L1] variable heavy Chain (SEQ ID NO: 667)
QVQLVESGGGVVQPGRSLRLSCAASGFTFSSYAMHWVRQAPGKGLEWVAVISFDGSNKYYADSVRGRFTISRDNS
KNTLYLQMNSLRTEDTAVYYCARGWLDRDIDYWGQGTLVTVSS >SH1B3[PD-L1] variable light Chain (SEQ ID NO: 668)
LPVLTQPASVSGSPGQSITISCTGTTSDIGGYDYVSWYQQHPGKAPKLMIYDVSKRPSGVSNRFSGSKSGNTASL
TISGLQAEDEADYYCSSYTSSSTHVFGTGTKLTVL >SH1D1[PD-L1] variable heavy Chain (SEQ ID NO: 669)
EVQLVESGGGVVQPGRSLRLSCAASGFTFSSYAMHWVRQAPGKGLEWVAVISFDGSNKYYADSVRGRFTISRDNS
KNTLYLQMNSLRTEDTAVYYCARGWLDRDIDYWGQGTLVTVSS >SH1D1[PD-L1] variable light Chain (SEQ ID NO: 670)
QSALTQPASVSGSPGQSITISCTGTSSDVGGYNYVSWYQQHPGKAPKLMIYDVSNRPSGVSNRFSGSKSGNTASL
TISGLQAEDEADYYCSSYRSSTLGPVFGGGTKLTVL >SH1D2[PD-L1] variable heavy Chain (SEQ ID NO: 671)
QVQLVESGGGVVQPGRSLRLSCAASGFTFSSYAMHWVRQAPGKGLEWVAVISFDGSNKYYADSVRGRFTISRDNS
KNTLYLQMNSLRTEDTAVYYCARGWLDRDIDYWGQGTLVTVSS >SH1D2[PD-L1] variable light Chain (SEQ ID NO: 672)
QAGLTQPPSVSEAPRQRVTISCSGSSSNIGNNAVNWYQQLPGKAPKLLIYYDDLLPSGVSDRFSGSKSGTSASLA
ISGLQSEDEADYYCAAWDDSLNGYVFGTGTKLTVL >SH1D12[PD-L1] variable heavy Chain (SEQ ID NO: 673)
EVQLVESGGGVVQPGRSLRLSCAASGFTFSSYAMHWVRQAPGKGLEWVAVISFDGSNKYYADSVRGRFTISRDNS
KNTLYLQMNSLRTEDTAVYYCARGWLDRDIDYWGQGTLVTVSS >SH1D12[PD-L1] variable light Chain (SEQ ID NO: 674)
QSALTQPRSVSGSPGQSVTISCTGTSSDVGGYNYVSWYQQHPGKAPKLMIYDVSKRPSGVPDRFSGSKSGNTASL
TISGLQAEDEADYYCSSYTSSTTHVFGTGTKVTVL

Figure 76G

>SH1E1[PD-L1] variable heavy Chain  (SEQ ID NO: 675)
EVQLVESGGGVVQPGRSLRLSCAASGFTFSSYAMHWVRQAPGKGLEWVAVISFDGSNKYYADSVRGRFTISRDNS
KNTLYLQMNSLRTEDTAVYYCARGWLDRDIDYWGQGTLVTVSS >SH1E1[PD-L1] variable light Chain  (SEQ ID NO: 676)
QSVVTQPPSVSAAPGQKVTISCSGSSSNIGNNYVSWYQQLPGTAPKLLIYDNNKRPSGIPDRFSGSKSGTSATLG
ITGLQTGDEADYYCGTWDSSLSVWVFGGGTQLTVL >SH1G9[PD-L1] variable heavy Chain  (SEQ ID NO: 677)
QVQLVESGGGVVQPGRSLRLSCAASGFTFSSYAMHWVRQAPGKGLEWVAVISFDGSNKYYADSVRGRFTISRDNS
KNTLYLQMNSLRTEDTAVYYCARGWLDRDIDYWGQGTLVTVSS >SH1G9[PD-L1] variable light Chain  (SEQ ID NO: 678)
QSVLTQPASVSGSPGQSITISCTGTSSDVGGYNYVSWYQQHPGRAPRLMIYDVSNRPSGVSNRFSGSKSGNTASL
TISGLQAEDEGDYYCSSYTSGGTLGPVFGGGTKLTVL >SH1E6[PD-L1] variable heavy Chain  (SEQ ID NO: 679)
QVQLVQSGAEVKKPGSSVKVSCKASGGTFSRYGVHWVRQAPGQGLEWMGRLIPIVSMTNYAQKFQDRVSITTDKS
TGTAYMELRSLTSEDTALYYCASVGQQLPWVFFAWGQGTLVTVSS >SH1E6[PD-L1] variable light Chain  (SEQ ID NO: 680)
QSVVTQPPSVSAAPGQKVTISCSGSSSNIGNNYVSWYQQLPGTAPKLLIYDNNKRPSGIPDRFSGSKSGTSATLG
ITGLQTGDEADYYCGTWDSSLSAVVFGGGTKLTVL >SH1A2[PD-L1] variable heavy Chain  (SEQ ID NO: 681)
QMQLVQSGGGVVQPGRSLRLSCAASGFTFSSYAMHWVRQAPGKGLEWVAVISFDGSNKYYADSVRGRFTISRDNS
KNTLYLQMNSLRTEDTAVYYCARGWLDRDIDYWGQGTLVTVSS >SH1A2[PD-L1] variable light Chain  (SEQ ID NO: 682)
QSVVTQPPSVSAAPGQKVTISCSGSSSNIGNNYVSWYQQVPGTAPKLLIYDNNKRPSGIPDRFSGSNSDTSATLG
ITGLQTGDEADYYCGTWDSSLSAWVFGGGTKLTVL >SH1B1[PD-L1] variable heavy Chain  (SEQ ID NO: 683)
QVQLVQSGGGVVQPGRSLRLSCAASGFTFSSYAMHWVRQAPGKGLEWVAVISFDGSNKYYADSVRGRFTISRDNS
KNTLYLQMNSLRTEDTAVYYCARGWLDRDIDYWGQGTLVTVSS >SH1B1[PD-L1] variable light Chain  (SEQ ID NO: 684)
QSVVTQPPSVSAAPGQKVTISCSGSSSNIGNNYVSWYQQLPGTAPKLLIYDNNKRPSGIPDRFSGSKSGTSATLG
ITGLQTGDEADYYCGTWDSSLSAGSVVFGGGTKLTVL >H6B1L[PD-L1] variable heavy Chain  (SEQ ID NO: 685)
QMQLVQSGAEVKKPGSSVKVSCKASGGTFSSYAYSWVRQAPGQGLEWMGGIIPSFGTANYAQKFQGRVTITADES
TSTAYMELSSLRSEDTAVYYCARGPIVATITPLDYWGQGTLVTVSS >H6B1L[PD-L1] variable light Chain  (SEQ ID NO: 686)
SYELMQPPSVSVAPGKTATIACGGENIGKKFVHWYQQKPGQAPVLVIYYDSDRPSGIPERFSGSNSGNTATLTIS
RVEAGDEADYYCLVWDSSSDHRIFGGGTKLTVL >H6A1[PD-L1] variable heavy Chain  (SEQ ID NO: 687)
QMQLVQSGAEVKKPGSSVKVSCKASGGTFSSYAYSWVRQAPGQGLEWMGGIIPIFGTANYAQKFQGRVTITADES
TSTAYMELSSLRSEDTAVYYCARGPIVATITPLDYWGQGTLVTVSS

Figure 76H

>H6A1[PD-L1] variable light Chain  (SEQ ID NO: 688)
SYELMQPPSVSVAPGKTATIACGGENIGRKTVHWYQQKPGQAPVLVIYYDSDRPSGIPERFSGSNSGNTATLTIS
RVEAGDEADYYCQVWDSSSDHRIFGGGTKLTVL >H6B1[PD-L1] variable heavy Chain  (SEQ ID NO: 689)
QMQLVQSGAEVKKPGSSVKVSCKASGGTFSSYAYSWVRQAPGQGLEWMGGIIPSFGTANYAQKFQGRVTITADES
TSTAYMELSSLRSEDTAVYYCARGPIVATITPLDYWGQGTLVTVSS >H6B1[PD-L1] variable light Chain  (SEQ ID NO: 690)
SYELMQPPSVSVAPGKTATIACGGENIGRKTVHWYQQKPGQAPVLVIYYDSDRPSGIPERFSGSNSGNTATLTIS
RVEAGDEADYYCQVWDSSSDHRIFGGGTKLTVL >H6B2[PD-L1] variable heavy Chain  (SEQ ID NO: 691)
QMQLVQSGAEVKKPGSSVKVSCKASGGTFSSYAISWVRQAPGQGLEWMGGIIPAFGTANYAQKFQGRVTITADES
TSTAYMELSSLRSEDTAVYYCARGPIVATITPLDYWGQGTLVTVSS >H6B2[PD-L1] variable light Chain  (SEQ ID NO: 692)
SYELMQPPSVSVAPGKTATIACGGENIGRKTVHWYQQKPGQAPVLVIYYDSDRPSGIPERFSGSNSGNTATLTIS
RVEAGDEADYYCQVWDSSSDHRIFGGGTKLTVL >G12[PD-L1] variable heavy Chain  (SEQ ID NO: 693)
EVQLVQSGAEVKKPGASVKVSCKASGYTFTGYYMHWVRQAPGQGLEWMGWINPNSDNTGSAQKFQGRVFMTKTTS
LNTAYMELSGLRSEDTAIYYCARERSSGYFDFWGQGTLVTVSS >G12[PD-L1] variable light Chain  (SEQ ID NO: 694)
DIVMTQSPSSLSASVGDRVTITCRASQSISSYLNWYQQKPGKAPKLLIYAASSLQSGVPSRFSGSGSGTDFTLTI
SSLQPEDFATYYCQQSYSTPITFGQGTRLEIK >RSA1[PD-L1] variable heavy Chain  (SEQ ID NO: 695)
EVQLVQSGGGLVQPGGSLRLSCAASGFTFSSYSMNWVRQAPGKGLEWVSYISSSSSTIYYADSVKGRFTISRDNA
KNSLYLQMNSLRDEDTAVYYCARGDYYYGMDVWGQGTTVTVSS >RSA1[PD-L1] variable light Chain  (SEQ ID NO: 696)
NIQMTQSPSSVSASVGDRVTITCRASQDISRWLAWYQQKPGKAPKLLIYAASSLQSGVPSRFSGSGSGTDFALTI
SSLQPEDFATYYCQQADSFFSITFGQGTRLEIK >RA3[PD-L1] variable heavy Chain  (SEQ ID NO: 697)
QMQLVQSGAEVKKPGSSVKVSCKASGGTFSRYGVHWVRQAPGQGLEWMGRLIFIVSMTNYAQKFQDRVSITTDKS
TGTAYMELRSLTSEDTALYYCASVGQQLPWVFFAWGQGTLVTVSS >RA3[PD-L1] variable light Chain  (SEQ ID NO: 698)
DIQMTQSPSSLSASVGDRVTITCQASQDISNYLNWYQQKPGKAPKLLIYDASTLQSGVPSRFSGSGSGTDFTLTI
SSLQPEDFATYYCQQSYSSHWTFGQGTKVEIK >SH1E2[PD-L1] variable heavy Chain  (SEQ ID NO: 699)
EVQLVESGAEVKKPGSSVKVSCKASGGTFSSYAISWVRQAPGQGLEWMGGIIPIFGTANYAQKFQGRVTITADES
TSTAYMELSSLRSEDTAVYYCARAPYYYYYMDVWGQGTTVTVSS >SH1E2[PD-L1] variable light Chain  (SEQ ID NO: 700)
QSALTQPASVSGSLGQSVTISCTGSSSDVGSYNLVSWYQQHPGKAPNLMIYDVSKRSGVSNRFSGSKSGNTASLT
ISGLQAEDEADYYCSSYTGISTVVFGGGTKLTVL

Figure 76I

>SH1E4[PD-L1] variable heavy Chain (SEQ ID NO: 701)
QVQLVQSGAEVKKPGSSVKVSCKASGGTFSRYGVHWVRQAPGQGLEWMGRLIPIVSMTNYAQKFQDRVSITTDKS
TGTAYMELRSLTSEDTALYYCASVGQQLPWVFFAWGQGTLVTVSS >SH1E4[PD-L1] variable light Chain (SEQ ID NO: 702)
QSVLTQPPSASGSPGQSVTISCTGTSSDIGGYDSVSWYQQHPGKAPKLMIYDVSKRPSGVSNRFSGSKSGNTASL
TISGLQAEDEADYYCSSYTSSSIFFYVFGTGTKVTVL >SH1B11[PD-L1] variable heavy Chain (SEQ ID NO: 703)
QVQLVQSGSELKKPGSSVKVSCKASGYSFSGYYIHWVRQAPGQGLEWMGWIDPNSGVTNYVRRFQGRVTMTRDTS
LSTAYMELSGLTADDTAVYYCARDENLWQFGYLDYWGQGTLVTVSS >SH1B11[PD-L1] variable light Chain (SEQ ID NO: 704)
DIVMTQSPSSLSASIGDRVTITCRASQRISAYVNWYQQKPGKAPKVLIYAASSLRSGVPSRFSGSGSGTDFTLTI
SSLQPEDFATYYCQQTYSSPWTFGQGTKVEIK >SH1C8[PD-L1] variable heavy Chain (SEQ ID NO: 705)
EVQLVESGGGVVQPGRSLRLSCAASGFTFSSYAMHWVRQAPGKGLEWVAVISYDGSNKYYADSVKGRFTISRDNS
KNTLYLQMNSLRAEDTAVYYCARGQWLVTELDYWGQGTLVTVSS >SH1C8[PD-L1] variable light Chain (SEQ ID NO: 706)
QSVVTQPPSVSAAPGQKVTISCSGSSSDIGNHYVSWYQQLPGTAPKLLIYDNNQRPSGIPDRFSGSKSGTSATLA
ITGLQTGDEADYYCGTWDNSLSPRLLFGGGTKLTVL >H1H9364P2[PD-L1] variable heavy Chain (SEQ ID NO: 707)
EVQLVESGGGLVQPGRSLRLSCAASGFTFDDYALHWVRQAPGKGLEWVSGISWTGGTIDYADSVKGRFTISRDNA
KNSLYLQMSSLRTEDTAIYYCTRDIRGNWKYGGWFDPWGQGTLVTVSS >H1H9364P2[PD-L1] variable light Chain (SEQ ID NO: 708)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPPITFGQGTRLEIK >H1H9373P2[PD-L1] variable heavy Chain (SEQ ID NO: 709)
QVQLVQSGTEVKKPGASVKVSCKASGYTFTAYYMHWVRQAPGQGLDWMGWISPNSGFTNYAQKFQGRVTMTRDTS
INTFYMELSGLRSDDTAVYYCAREGSTHHNSFDPWGQGTLVTVSS >H1H9373P2[PD-L1] variable light Chain (SEQ ID NO: 710)
DIQMTQSPSSLSASVGDRVTITCRASQSISSYLNWYQQKPGKAPKLLIYAASSLQSGVPSRFSGSGSGTDFTLTI
SSLQPEDFATYYCQQSYSTPPITFGQGTRLEIK >H1H8314N[PD-L1] variable heavy Chain (SEQ ID NO: 711)
EVQLVESGGGVVRPGGSLRLSCAASGFTFDDYGMTWVRQAPGRGLEWVSGIHWHGKRTGYADSVKGRFTISRDNA
KKSLYLQMNSLKGEDTALYHCVRGGMSTGDWFDPWGQGTLVIVSS >H1H8314N[PD-L1] variable light Chain (SEQ ID NO: 712)
DIQMTQSPSSLSASLGDRVTITCRASQSINSYLNWYQQKPGKAPKLLIYVASSLQSGVPSRFSGSGSGTEFTLTI
SNLQPEDFATYYCQQSYSTPPITFGQGTRLEIK >PDL1.3.1[PD-L1] variable heavy Chain (SEQ ID NO: 713)
EVQLQQSGTELVKPGASVKLSCTTSGFNIQDTYMHWVKQRPEQGLEWIGWIDPANGNTKYDPKFQGKATIIADTS
SNTAYLQLRGLTSEDTAVYYCARSGVSTAHFDYWGQGTTLTVSS

Figure 76J

>PDL1.3.1[PD-L1] variable light Chain (SEQ ID NO: 714)
QIVLSQSPAILSASPGEKVTMTCRASSSVSEMHWYQQKPGSSPKPWIYATSNLASGVPTRFSGSGSGTSYSLTLS
RVEAEDAATYYCQQWSSYPRTFGGGTKLEIK

Figure 77

Targeted IL-12-Fc Backbone 1

>Chain 1 (SEQ ID NO: 715)
ASTKGPSVFPLAPSSKSTSGGTAALGCLVKDYFPEPVTVSWNSGALTSGVHTFPAVLQSSGLYSLSSVVTVPSSSLGTQTYICNVNHKPS
NTKVDKKVEPKSCDKTHTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREEMTKNQVKLTCLVKGFYPSDIAVEWESNGQPE
NNYKTTPPVLDSDGSFFLYSKLTVDKSRWQQGNVFSCSVMHEALHNHYTQKSLSLSPGK >Chain 2 (SEQ ID NO: 716)
EPKSSDKTHTCPPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDGQPENNYKTTPP
VLDSDGSFFLYSKLTVDKSRWEQGDVFSCSVMHEALHNHYTQKSLSLSPGK

Targeted IL-12-Fc Backbone 2

>Chain 1 (SEQ ID NO: 717)
ASTKGPSVFPLAPSSKSTSGGTAALGCLVKDYFPEPVTVSWNSGALTSGVHTFPAVLQSSGLYSLSSVVTVPSSSLGTQTYICNVNHKPS
DTKVDKKVEPKSCDKTHTCPPCPAPPVAGPSVFLFPPKPKDTLMISRTPEVTCVVVDVKHEDPEVKFNWYVDGVEVHNAKTKPREEEYNS
TYRVVSVLTVLHQDWLNGKEYKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK >Chain 2 (SEQ ID NO: 718)
EPKSSDKTHTCPPCPAPPVAGPSVFLFPPKPKDTLMISRTPEVTCVVVDVKHEDPEVKFNWYVDGVEVHNAKTKPREEQYNSTYRVVSVL
TVLHQDWLNGKEYKCKVSNKALPAPIEKTISKAKGQPREPQVYTLPPSREQMTKNQVKLTCLVKGFYPSDIAVEWESNGQPENNYKTTPP
VLDSDGSFFLYSKLTVDKSRWQQGNVFSCSVMHEALHNHYTQKSLSLSPGK

Targeted IL-12-Fc Backbone 3

>Chain 1 (SEQ ID NO: 717)
ASTKGPSVFPLAPSSKSTSGGTAALGCLVKDYFPEPVTVSWNSGALTSGVHTFPAVLQSSGLYSLSSVVTVPSSSLGTQTYICNVNHKPS
DTKVDKKVEPKSCDKTHTCPPCPAPPVAGPSVFLFPPKPKDTLMISRTPEVTCVVVDVKHEDPEVKFNWYVDGVEVHNAKTKPREEEYNS
TYRVVSVLTVLHQDWLNGKEYKCKVSNKALPAPIEKTISKAKGQPREPQVYTLPPSREEMTKNQVSLTCDVSGFYPSDIAVEWESDGQPE
NNYKTTPPVLDSDGSFFLYSKLTVDKSRWEQGDVFSCSVMHEALHNHYTQKSLSLSPGK >Chain 2 (SEQ ID NO: 719)
ASTKGPSVFPLAPSSKSTSGGTAALGCLVKDYFPEPVTVSWNSGALTSGVHTFPAVLQSSGLYSLSSVVTVPSSSLGTKTYTCNVNHKPS
NTKVDKKVERKSCDKTHTCPRCPAPPVAGPSVFLFPPKPKDTLMISRTPEVTCVVVDVKHEDPEVKFKWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFYPSDIAVEWESNGQPE
NNYKTTPPVLDSDGSFFLYSKLTVDKSRWQQGNVFSCSVMHEALHNHYTQKSLSLSPGK

Figure 78

Constant Light Chain – Kappa (SEQ ID NO: 720)
RTVAAPSVFIFPPSDEQLKSGTASVVCLLNNFYPREAKVQWKVDNALQSGNSQESVTEQDSKDSTYSLSSTLTLSKADYEKHKVYACEVT
HQGLSSPVTKSFNRGEC

Constant Light Chain – Lambda (SEQ ID NO: 721)
GQPKAAPSVTLFPPSSEELQANKATLVCLISDFYPGAVTVAWKADSSPVKAGVETTTPSKQSNNKYAASSYLSLT
PEQWKSHRSYSCQVTHEGSTVEKTVAPTECS

Figure 80A

>XENP28792 human_IL12p40_(GGGGS)5-human_IL12p35_(GGGGS)2_(single-chain)-1C11[PD-
1]_H3L3_Fc(216)_IgG1_pI(-)_Isosteric_A_C220S/PVA_/S267K/L368D/K370S-
IgG1_PVA_/S267K/S364K/E357Q Chain 1 - human_IL12p40_(GGGGS)5-human_IL12p35_(GGGGS)2_(single-chain)_Fc(216)_IgG1_pI(-
)_Isosteric_A_C220S/PVA_/S267K/L368D/K370S (SEQ ID NO: 722)
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK Chain 2 - 1C11[PD-1]_H3_IgG1_PVA_/S267K/S364K/E357Q (SEQ ID NO: 723)
QIQLVQSGSELKKPGASVKVSCKASGYTFTRYGMNWVRQAPGQGLEWMGWINTYTGEPTYADGFTGRFVFSLDTS
VSTAYLQISSLKAEDTAVYFCARDYYGSSPYWGQGTLVTVSS/ASTKGPSVFPLAPSSKSTSGGTAALGCLVKDY
FPEPVTVSWNSGALTSGVHTFPAVLQSSGLYSLSSVVTVPSSSLGTQTYICNVNHKPSNTKVDKKVEPKSCDKTH
TCPPCPAPPVAGPSVFLFPPKPKDTLMISRTPEVTCVVVDVKHEDPEVKFNWYVDGVEVHNAKTKPREEQYNSTY
RVVSVLTVLHQDWLNGKEYKCKVSNKALPAPIEKTISKAKGQPREPQVYTLPPSREQMTKNQVKLTCLVKGFYPS
DIAVEWESNGQPENNYKTTPPVLDSDGSFFLYSKLTVDKSRWQQGNVFSCSVMHEALHNHYTQKSLSLSPGK Chain 3 - 1C11[PD-1]_L3 (SEQ ID NO: 724)
DVLMTQSPDSLAVSLGERATINCKSSQSIVHSNGNTYLEWYQQKPGQSPKLLIYKVSNRFSGVPDRFSGSGSGTD
FTLTISSLQAEDVAVYYCFQGSHVPNTFGGGTKVEIK/RTVAAPSVFIFPPSDEQLKSGTASVVCLLNNFYPREA
KVQWKVDNALQSGNSQESVTEQDSKDSTYSLSSTLTLSKADYEKHKVYACEVTHQGLSSPVTKSFNRGEC >XENP28793 human_IL12p40_(GGGGS)5-human_IL12p35_(GGGGS)2_(single-chain)-MAB A[PD-
1]_H1L1_Fc(216)_IgG1_pI(-)_Isosteric_A_C220S/PVA_/S267K/L368D/K370S-IgG1_PVA_/S267K/S364K/E357Q Chain 1 - human_IL12p40_(GGGGS)5-human_IL12p35_(GGGGS)2_(single-chain)_Fc(216)_IgG1_pI(-
)_Isosteric_A_C220S/PVA_/S267K/L368D/K370S (SEQ ID NO: 722)
IWELKKDVYVVELDWYPDAPGEMVVLTCDTPEEDGITWTLDQSSEVLGSGKTLTIQVKEFGDAGQYTCHKGGEVLSHSL
LLLHKKEDGIWSTDILKDQKEPKNKTFLRCEAKNYSGRFTCWWLTTISTDLTFSVKSSRGSSDPQGVTCGAATLSAERV
RGDNKEYEYSVECQEDSACPAAEESLPIEVMVDAVHKLKYENYTSSFFIRDIIKPDPPKNLQLKPLKNSRQVEVSWEYP
DTWSTPHSYFSLTFCVQVQGKSKREKKDRVFTDKTSATVICRKNASISVRAQDRYYSSSWSEWASVPCS/GGGGSGGGG
SGGGGSGGGGSGGGGS/RNLPVATPDPGMFPCLHHSQNLLRAVSNMLQKARQTLEFYPCTSEEIDHEDITKDKTSTVEA
CLPLELTKNESCLNSRETSFITNGSCLASRKTSFMMALCLSSIYEDLKMYQVEFKTMNAKLLMDPKRQIFLDQNMLAVI
DELMQALNFNSETVPQKSSLEEPDFYKTKIKLCILLHAFRIRAVTIDRVMSYLNAS/GGGGSGGGGS/EPKSSDKTHTC
PPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK Chain 2 - MAB A[PD-1]_H1_IgG1_PVA_/S267K/S364K/E357Q (SEQ ID NO: 725)
QVQLQESGPGLVKPSQTLSLTCTVSGHSITSDYAWNWIRQPPGKKLEWIGYISYSGYTTYNPSLKSRVTISRDTSKNQF
SLKLSSVTAADTAVYFCARDLDYGPWFAYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAPPV
AGPSVFLFPPKPKDTLMISRTPEVTCVVVDVKHEDPEVKFNWYVDGVEVHNAKTKPREEQYNSTYRVVSVLTVLHQDWL
NGKEYKCKVSNKALPAPIEKTISKAKGQPREPQVYTLPPSREQMTKNQVKLTCLVKGFYPSDIAVEWESNGQPENNYKT
TPPVLDSDGSFFLYSKLTVDKSRWQQGNVFSCSVMHEALHNHYTQKSLSLSPGK Chain 3 - MAB A[PD-1]_L1 (SEQ ID NO: 726)
DIQMTQSPSSLSASVGDRVTITCRASENIHNYLAWYQQKPGKSPKLLVYNVKTLADGVPSRFSGSGSGTDYTLTISSLQ
PEDFATYYCQHFWSSPWTFGGGTKVEIK/RTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC

Figure 80B

>XENP28794_human_IL12p40_(GGGGS)5-human_IL12p35_(GGGGS)2_(single-chain)-mAb C[PD-1]_H1L1_Fc(216)_IgG1_pI(-)_Isosteric_A_C220S/PVA_/S267K/L368D/K370S-IgG1_PVA_/S267K/S364K/E357Q Chain 1 - human_IL12p40_(GGGGS)5-human_IL12p35_(GGGGS)2_(single-chain)_Fc(216)_IgG1_pI(-)_Isosteric_A_C220S/PVA_/S267K/L368D/K370S (SEQ ID NO: 722)
IWELKKDVYVVELDWYPDAPGEMVVLTCDTPEEDGITWTLDQSSEVLGSGKTLTIQVKEFGDAGQYTCHKGGEVLSHSL
LLLHKKEDGIWSTDILKDQKEPKNKTFLRCEAKNYSGRFTCWWLTTISTDLTFSVKSSRGSSDPQGVTCGAATLSAERV
RGDNKEYEYSVECQEDSACPAAEESLPIEVMVDAVHKLKYENYTSSFFIRDIIKPDPPKNLQLKPLKNSRQVEVSWEYP
DTWSTPHSYFSLTFCVQVQGKSKREKKDRVFTDKTSATVICRKNASISVRAQDRYYSSSWSEWASVPCS/GGGGSGGGG
SGGGGSGGGGSGGGGS/RNLPVATPDPGMFPCLHHSQNLLRAVSNMLQKARQTLEFYPCTSEEIDHEDITKDKTSTVEA
CLPLELTKNESCLNSRETSFITNGSCLASRKTSFMMALCLSSIYEDLKMYQVEFKTMNAKLLMDPKRQIFLDQNMLAVI
DELMQALNFNSETVPQKSSLEEPDFYKTKIKLCILLHAFRIRAVTIDRVMSYLNAS/GGGGSGGGGS/EPKSSDKTHTC
PPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK Chain 2 - mAb C[PD-1]_H1_IgG1_PVA_/S267K/S364K/E357Q (SEQ ID NO: 727)
EVQLVESGGGLVQPGGSLRLSCAASGFTFSSFGMHWVRQAPGKGLEWVSYISSGSSIIYYADSVKGRFTISRDNAKNSL
YLQMNSLRAEDTAVYYCARGGKLVWSPDYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAPPV
AGPSVFLFPPKPKDTLMISRTPEVTCVVVDVKHEDPEVKFNWYVDGVEVHNAKTKPREEQYNSTYRVVSVLTVLHQDWL
NGKEYKCKVSNKALPAPIEKTISKAKGQPREPQVYTLPPSREEMTKNQVKLTCLVKGFYPSDIAVEWESNGQPENNYKT
TPPVLDSDGSFFLYSKLTVDKSRWQQGNVFSCSVMHEALHNHYTQKSLSLSPGK Chain 3 - mAb C[PD-1]_L1 (SEQ ID NO: 728)
DIVMTQSPDSLAVSLGERATINCKSSQSLLNSGNQKNYLTWYQQKPGQPPKLLIYWASTRESGVPDRFTGSGSGTDFTL
TISSLQAEDVAVYYCQNDYSYPFTFGSGTKLEIK/RTVAAPSVFIFPPSDEQLKSGTASVVCLLNNFYPREAKVQWKVD
NALQSGNSQESVTEQDSKDSTYSLSSTLTLSKADYEKHKVYACEVTHQGLSSPVTKSFNRGEC >XENP28796_human_IL12p40_(GGGGS)5-human_IL12p35_(GGGGS)2_(single-chain)-mAb B[PD-1]_H1L1_Fc(216)_IgG1_pI(-)_Isosteric_A_C220S/PVA_/S267K/L368D/K370S-IgG1_PVA_/S267K/S364K/E357Q Chain 1 - human_IL12p40_(GGGGS)5-human_IL12p35_(GGGGS)2_(single-chain)_Fc(216)_IgG1_pI(-)_Isosteric_A_C220S/PVA_/S267K/L368D/K370S (SEQ ID NO: 722)
IWELKKDVYVVELDWYPDAPGEMVVLTCDTPEEDGITWTLDQSSEVLGSGKTLTIQVKEFGDAGQYTCHKGGEVLSHSL
LLLHKKEDGIWSTDILKDQKEPKNKTFLRCEAKNYSGRFTCWWLTTISTDLTFSVKSSRGSSDPQGVTCGAATLSAERV
RGDNKEYEYSVECQEDSACPAAEESLPIEVMVDAVHKLKYENYTSSFFIRDIIKPDPPKNLQLKPLKNSRQVEVSWEYP
DTWSTPHSYFSLTFCVQVQGKSKREKKDRVFTDKTSATVICRKNASISVRAQDRYYSSSWSEWASVPCS/GGGGSGGGG
SGGGGSGGGGSGGGGS/RNLPVATPDPGMFPCLHHSQNLLRAVSNMLQKARQTLEFYPCTSEEIDHEDITKDKTSTVEA
CLPLELTKNESCLNSRETSFITNGSCLASRKTSFMMALCLSSIYEDLKMYQVEFKTMNAKLLMDPKRQIFLDQNMLAVI
DELMQALNFNSETVPQKSSLEEPDFYKTKIKLCILLHAFRIRAVTIDRVMSYLNAS/GGGGSGGGGS/EPKSSDKTHTC
PPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK Chain 2 - mAb B[PD-1]_H1_IgG1_PVA_/S267K/S364K/E357Q (SEQ ID NO: 729)
QVQLVQSGAEVKKPGASVKVSCKASGYTFTNFYIHWVRQAPGQSIEWMGSIYPNYGDTAYNQKFQGRVTMTVDKSISTA
YMELSRLRSDDTAVYYCARGYSYAMDYWGQGTLVTVSS/ASTKGPSVFPLAPSSKSTSGGTAALGCLVKDYFPEPVTVS
WNSGALTSGVHTFPAVLQSSGLYSLSSVVTVPSSSLGTQTYICNVNHKPSNTKVDKKVEPKSCDKTHTCPPCPAPPVAG
PSVFLFPPKPKDTLMISRTPEVTCVVVDVKHEDPEVKFNWYVDGVEVHNAKTKPREEQYNSTYRVVSVLTVLHQDWLNG
KEYKCKVSNKALPAPIEKTISKAKGQPREPQVYTLPPSREEMTKNQVKLTCLVKGFYPSDIAVEWESNGQPENNYKTTP
PVLDSDGSFFLYSKLTVDKSRWQQGNVFSCSVMHEALHNHYTQKSLSLSPGK Chain 3 - mAb B[PD-1]_L1 (SEQ ID NO: 730)
DIQMTQSPSSLSASVGDRVTITCRASQSISGDLNWYQQKPGKTVKLLIYHTSSLHSGVPLRFSGSGSGTDYTLTISSLQ
PEDFATYYCQYYSKDLLTFGAGTKLEIK/RTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC

Figure 80C

>XENP31073 human_IL12p40_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S-IgG1_PVA_/S267K/S364K/E357Q Chain 1 - human_IL12p40_(GGGGS)5-human_IL12p35_(GGGGS)2_(single-chain)_Fc(216)_IgG1_pI(-)_Isosteric_A_C220S/PVA_/S267K/L368D/K370S (SEQ ID NO: 722)

*IWELKKDVYVVELDWYPDAPGEMVVLTCDTPEEDGITWTLDQSSEVLGSGKTLTIQVKEFGDAGQYTCHKGGEVLSHSL
LLLHKKEDGIWSTDILKDQKEPKNKTFLRCEAKNYSGRFTCWWLTTISTDLTFSVKSSRGSSDPQGVTCGAATLSAERV
RGDNKEYEYSVECQEDSACPAAEESLPIEVMVDAVHKLKYENYTSSFFIRDIIKPDPPKNLQLKPLKNSRQVEVSWEYP
DTWSTPHSYFSLTFCVQVQGKSKREKKDRVFTDKTSATVICRKNASISVRAQDRYYSSSWSEWASVPCS/*<u>GGGGSGGGG
SGGGGSGGGGSGGGGS</u>*/RNLPVATPDPGMFPCLHHSQNLLRAVSNMLQKARQTLEFYPCTSEEIDHEDITKDKTSTVEA
CLPLELTKNESCLNSRETSFITNGSCLASRKTSFMMALCLSSIYEDLKMYQVEFKTMNAKLLMDPKRQIFLDQNMLAVI
DELMQALNFNSETVPQKSSLEEPDFYKTKIKLCILLHAFRIRAVTIDRVMSYLNAS/*<u>GGGGSGGGGS</u>*/EPKSSDKTHTC
PPCPAPPVAGPSVFLFPPKPKDTLMISRTPEVTCVVVDVSHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK*

Chain 2 - mAb C[PD-1]_H1IgG1_PVA_/S267K/S364K/E357Q (SEQ ID NO: 727)
EVQLVESGGGLVQPGGSLRLSCAASGFTFS<u>SFGMH</u>WVRQAPGKGLEWVS<u>YISSGSSIIYYADSVK</u>GRFTISRDNAKNSL
YLQMNSLRAEDTAVYYCAR<u>GGRLVWSPDY</u>WGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAPPV
AGPSVFLFPPKPKDTLMISRTPEVTCVVVDVSHEDPEVKFNWYVDGVEVHNAKTKPREEQYNSTYRVVSVLTVLHQDWL
NGKEYKCKVSNKALPAPIEKTISKAKGQPREPQVYTLPPSREQMTKNQVKLTCLVKGFYPSDIAVEWESNGQPENNYKT
TPPVLDSDGSFFLYSKLTVDKSRWQQGNVFSCSVMHEALHNHYTQKSLSLSPGK Chain 3 - mAb C[PD-1]_L1.1 (SEQ ID NO: 732)
DIVMTQSPDSLAVSLGERATINCK<u>SSQSLLHSGNQKNYL</u>TWYQQKPGQPPKLLIY<u>WASTRES</u>GVPDRFTGSGSGTDFTL
TISSLQAEDVAVYYCQ<u>NDYSYPFT</u>FGSGTKLEIK/RTVAAPSVFIFPPSDEQLKSGTASVVCLLNNFYPREAKVQWKVD
NALQSGNSQESVTEQDSKDSTYSLSSTLTLSKADYEKHKVYACEVTHQGLSSPVTKSFNRGEC >XENP31074 human_IL12p40_E32Q/D34N/E59K/K99E_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S-IgG1_PVA_/S267K/S364K/E357Q Chain 1 - human_IL12p40_E32Q/D34N/E59K/K99E_(GGGGS)5-human_IL12p35_(GGGGS)2_(single-chain)_Fc(216)_IgG1_pI(-)_Isosteric_A_C220S/PVA_/S267K/L368D/K370S (SEQ ID NO: 733)

*IWELKKDVYVVELDWYPDAPGEMVVLTCDTPQENGITWTLDQSSEVLGSGKTLTIQVKKFGDAGQYTCHKGGEVLSHSL
LLLHKKEDGIWSTDILKDQEEPKNKTFLRCEAKNYSGRFTCWWLTTISTDLTFSVKSSRGSSDPQGVTCGAATLSAERV
RGDNKEYEYSVECQEDSACPAAEESLPIEVMVDAVHKLKYENYTSSFFIRDIIKPDPPKNLQLKPLKNSRQVEVSWEYP
DTWSTPHSYFSLTFCVQVQGKSKREKKDRVFTDKTSATVICRKNASISVRAQDRYYSSSWSEWASVPCS/*<u>GGGGSGGGG
SGGGGSGGGGSGGGGS</u>*/RNLPVATPDPGMFPCLHHSQNLLRAVSNMLQKARQTLEFYPCTSEEIDHEDITKDKTSTVEA
CLPLELTKNESCLNSRETSFITNGSCLASRKTSFMMALCLSSIYEDLKMYQVEFKTMNAKLLMDPKRQIFLDQNMLAVI
DELMQALNFNSETVPQKSSLEEPDFYKTKIKLCILLHAFRIRAVTIDRVMSYLNAS/*<u>GGGGSGGGGS</u>*/EPKSSDKTHTC
PPCPAPPVAGPSVFLFPPKPKDTLMISRTPEVTCVVVDVSHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK*

Chain 2 - mAb C[PD-1]_H1IgG1_PVA_/S267K/S364K/E357Q (SEQ ID NO: 727)
EVQLVESGGGLVQPGGSLRLSCAASGFTFS<u>SFGMH</u>WVRQAPGKGLEWVS<u>YISSGSSIIYYADSVK</u>GRFTISRDNAKNSL
YLQMNSLRAEDTAVYYCAR<u>GGRLVWSPDY</u>WGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAPPV
AGPSVFLFPPKPKDTLMISRTPEVTCVVVDVSHEDPEVKFNWYVDGVEVHNAKTKPREEQYNSTYRVVSVLTVLHQDWL
NGKEYKCKVSNKALPAPIEKTISKAKGQPREPQVYTLPPSREQMTKNQVKLTCLVKGFYPSDIAVEWESNGQPENNYKT
TPPVLDSDGSFFLYSKLTVDKSRWQQGNVFSCSVMHEALHNHYTQKSLSLSPGK Chain 3 - mAb C[PD-1]_L1.1 (SEQ ID NO: 732)
DIVMTQSPDSLAVSLGERATINCK<u>SSQSLLHSGNQKNYL</u>TWYQQKPGQPPKLLIY<u>WASTRES</u>GVPDRFTGSGSGTDFTL
TISSLQAEDVAVYYCQ<u>NDYSYPFT</u>FGSGTKLEIK/RTVAAPSVFIFPPSDEQLKSGTASVVCLLNNFYPREAKVQWKVD
NALQSGNSQESVTEQDSKDSTYSLSSTLTLSKADYEKHKVYACEVTHQGLSSPVTKSFNRGEC

Figure 80D

>XENP31106 human_IL12p40_E59K/K99E_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S-IgG1_PVA_/S267K/S364K/E357Q Chain 1 - human_IL12p40_E59K/K99E_(GGGGS)5-human_IL12p35_(GGGGS)2_(single-chain)_Fc(216)_IgG1_pI(-)_Isosteric_A_C220S/PVA_/S267K/L368D/K370S (SEQ ID NO: 735)
IWELKKDVYVVELDWYPDAPGEMVVLTCDTPEEDGITWTLDQSSEVLGSGKTLTIQVKKFGDAGQYTCHKGGEVLSHSL
LLLHKKEDGIWSTDILKDQEEPKNKTFLRCEAKNYSGRFTCWWLTTISTDLTFSVKSSRGSSDPQGVTCGAATLSAERV
RGDNKEYEYSVECQEDSACPAAEESLPIEVMVDAVHKLKYENYTSSFFIRDIIKPDPPKNLQLKPLKNSRQVEVSWEYP
DTWSTPHSYFSLTFCVQVQGKSREKKDRVFTDKTSATVICRKNASISVRAQDRYYSSSWSEWASVPCS/GGGGSGGGG
SGGGGSGGGGSGGGGS/RNLPVATPDPGMFPCLHHSQNLLRAVSNMLQKARQTLEFYPCTSEEIDHEDITKDKTSTVEA
CLPLELTKNESCLNSRETSFITNGSCLASRKTSFMMALCLSSIYEDLKMYQVEFKTMNAKLLMDPKRQIFLDQNMLAVI
DELMQALNFNSETVPQKSSLEEPDFYKTKIKLCILLHAFRIRAVTIDRVMSYLNAS/GGGGSGGGGS/EPKSSDKTHTC
PPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK Chain 2 - mAb C[PD-1]_H1IgG1_PVA_/S267K/S364K/E357Q (SEQ ID NO: 727)
EVQLVESGGGLVQPGGSLRLSCAASGFTFSSFGMHWVRQAPGKGLEWVSYISSGSSIIYYADSVKGRFTISRDNAKNSL
YLQMNSLRAEDTAVYYCARGGRLVWSPDYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAPPV
AGPSVFLFPPKPKDTLMISRTPEVTCVVVDVKHEDPEVKFNWYVDGVEVHNAKTKPREEQYNSTYRVVSVLTVLHQDWL
NGKEYKCKVSNKALPAPIEKTISKAKGQPREPQVYTLPPSREQMTKNQVKLTCLVKGFYPSDIAVEWESNGQPENNYKT
TPPVLDSDGSFFLYSKLTVDKSRWQQGNVFSCSVMHEALHNHYTQKSLSLSPGK Chain 3 - mAb C[PD-1]_L1.1 (SEQ ID NO: 732)
DIVMTQSPDSLAVSLGERATINCKSSQSLLHSGNQKNYLTWYQQKPGQPPKLLIYWASTRESGVPDRFTGSGSGTDFTL
TISSLQAEDVAVYYCQNDYSYPFTFGSGTKLEIK/RTVAAPSVFIFPPSDEQLKSGTASVVCLLNNFYPREAKVQWKVD
NALQSGNSQESVTEQDSKDSTYSLSSTLTLSKADYEKHKVYACEVTHQGLSSPVTKSFNRGEC >XENP31136 human_IL12p40_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S/M428L/N434S-IgG1_PVA_/S267K/S364K/E357Q/M428L/N434S Chain 1 - human_IL12p40_(GGGGS)5-human_IL12p35_(GGGGS)2_(single-chain)_Fc(216)_IgG1_pI(-)_Isosteric_A_C220S/PVA_/S267K/L368D/K370S/M428L/N434S (SEQ ID NO: 736)
IWELKKDVYVVELDWYPDAPGEMVVLTCDTPEEDGITWTLDQSSEVLGSGKTLTIQVKEFGDAGQYTCHKGGEVLSHSL
LLLHKKEDGIWSTDILKDQKEPKNKTFLRCEAKNYSGRFTCWWLTTISTDLTFSVKSSRGSSDPQGVTCGAATLSAERV
RGDNKEYEYSVECQEDSACPAAEESLPIEVMVDAVHKLKYENYTSSFFIRDIIKPDPPKNLQLKPLKNSRQVEVSWEYP
DTWSTPHSYFSLTFCVQVQGKSREKKDRVFTDKTSATVICRKNASISVRAQDRYYSSSWSEWASVPCS/GGGGSGGGG
SGGGGSGGGGSGGGGS/RNLPVATPDPGMFPCLHHSQNLLRAVSNMLQKARQTLEFYPCTSEEIDHEDITKDKTSTVEA
CLPLELTKNESCLNSRETSFITNGSCLASRKTSFMMALCLSSIYEDLKMYQVEFKTMNAKLLMDPKRQIFLDQNMLAVI
DELMQALNFNSETVPQKSSLEEPDFYKTKIKLCILLHAFRIRAVTIDRVMSYLNAS/GGGGSGGGGS/EPKSSDKTHTC
PPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVLHEALHSHYTQKSLSLSPGK Chain 2 - mAb C[PD-1]_H1_IgG1_PVA_/S267K/S364K/E357Q/M428L/N434S (SEQ ID NO: 737)
EVQLVESGGGLVQPGGSLRLSCAASGFTFSSFGMHWVRQAPGKGLEWVSYISSGSSIIYYADSVKGRFTISRDNAKNSL
YLQMNSLRAEDTAVYYCARGGRLVWSPDYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAPPV
AGPSVFLFPPKPKDTLMISRTPEVTCVVVDVKHEDPEVKFNWYVDGVEVHNAKTKPREEQYNSTYRVVSVLTVLHQDWL
NGKEYKCKVSNKALPAPIEKTISKAKGQPREPQVYTLPPSREQMTKNQVKLTCLVKGFYPSDIAVEWESNGQPENNYKT
TPPVLDSDGSFFLYSKLTVDKSRWQQGNVFSCSVLHEALHSHYTQKSLSLSPGK Chain 3 - mAb C[PD-1]_L1.1 (SEQ ID NO: 732)
DIVMTQSPDSLAVSLGERATINCKSSQSLLHSGNQKNYLTWYQQKPGQPPKLLIYWASTRESGVPDRFTGSGSGTDFTL
TISSLQAEDVAVYYCQNDYSYPFTFGSGTKLEIK/RTVAAPSVFIFPPSDEQLKSGTASVVCLLNNFYPREAKVQWKVD
NALQSGNSQESVTEQDSKDSTYSLSSTLTLSKADYEKHKVYACEVTHQGLSSPVTKSFNRGEC

Figure 80E

>XENP31137 human_IL12p40_E32Q/D34N/E59K/K99E_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S/M428L/N434S-IgG1_PVA_/S267K/S364K/E357Q/M428L/N434S Chain 1 - human_IL12p40_E32Q/D34N/E59K/K99E_(GGGGS)5-human_IL12p35_(GGGGS)2_(single-chain)_Fc(216)_IgG1_pI(-)_Isosteric_A_C220S/PVA_/S267K/L368D/K370S/M428L/N434S (SEQ ID NO: 738)
IWELKKDVYVVELDWYPDAPGEMVVLTCDTPQENGITWTLDQSSEVLGSGKTLTIQVKKFGDAGQYTCHKGGEVLSHSL
LLLHKKEDGIWSTDILKDQEEPKNKTFLRCEAKNYSGRFTCWWLTTISTDLTFSVKSSRGSSDPQGVTCGAATLSAERV
RGDNKEYEYSVECQEDSACPAAEESLPIEVMVDAVHKLKYENYTSSFFIRDIIKPDPPKNLQLKPLKNSRQVEVSWEYP
DTWSTPHSYFSLTFCVQVQGKSKREKKDRVFTDKTSATVICRKNASISVRAQDRYYSSSWSEWASVPCS/GGGGSGGGG
SGGGGSGGGGSGGGGS/RNLPVATPDPGMFPCLHHSQNLLRAVSNMLQKARQTLEFYPCTSEEIDHEDITKDKTSTVEA
CLPLELTKNESCLNSRETSFITNGSCLASRKTSFMMALCLSSIYEDLKMYQVEFKTMNAKLLMDPKRQIFLDQNMLAVI
DELMQALNFNSETVPQKSSLEEPDFYKTKIKLCILLHAFRIRAVTIDRVMSYLNAS/GGGGSGGGGS/EPKSSDKTHTC
PPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVLHEALHSHYTQKSLSLSPGK Chain 2 - mAb C[PD-1]_H1_IgG1_PVA_/S267K/S364K/E357Q/M428L/N434S (SEQ ID NO: 737)
EVQLVESGGGLVQPGGSLRLSCAASGFTFSSFGMHWVRQAPGKGLEWVSYISSGSSIIYYADSVKGRFTISRDNAKNSL
YLQMNSLRAEDTAVYYCARGGRLVWSPDYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAPPV
AGPSVFLFPPKPKDTLMISRTPEVTCVVVDVKHEDPEVKFNWYVDGVEVHNAKTKPREEQYNSTYRVVSVLTVLHQDWL
NGKEYKCKVSNKALPAPIEKTISKAKGQPREPQVYTLPPSREQMTKNQVKLTCLVKGFYPSDIAVEWESNGQPENNYKT
TPPVLDSDGSFFLYSKLTVDKSRWQQGNVFSCSVLHEALHSHYTQKSLSLSPGK Chain 3 - mAb C[PD-1]_L1.1 (SEQ ID NO: 732)
DIVMTQSPDSLAVSLGERATINCKSSQSLLHSGNQKNYLTWYQQKPGQPPKLLIYWASTRESGVPDRFTGSGSGTDFTL
TISSLQAEDVAVYYCQNDYSYPFTFGSGTKLEIK/RTVAAPSVFIFPPSDEQLKSGTASVVCLLNNFYPREAKVQWKVD
NALQSGNSQESVTEQDSKDSTYSLSSTLTLSKADYEKHKVYACEVTHQGLSSPVTKSFNRGEC >XENP31140 human_IL12p40_E59K/K99E_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S/M428L/N434S-IgG1_PVA_/S267K/S364K/E357Q/M428L/N434S Chain 1 - human_IL12p40_E59K/K99E_(GGGGS)5-human_IL12p35_(GGGGS)2_(single-chain)_Fc(216)_IgG1_pI(-)_Isosteric_A_C220S/PVA_/S267K/L368D/K370S/M428L/N434S (SEQ ID NO: 739)
IWELKKDVYVVELDWYPDAPGEMVVLTCDTPEEDGITWTLDQSSEVLGSGKTLTIQVKKFGDAGQYTCHKGGEVLSHSL
LLLHKKEDGIWSTDILKDQEEPKNKTFLRCEAKNYSGRFTCWWLTTISTDLTFSVKSSRGSSDPQGVTCGAATLSAERV
RGDNKEYEYSVECQEDSACPAAEESLPIEVMVDAVHKLKYENYTSSFFIRDIIKPDPPKNLQLKPLKNSRQVEVSWEYP
DTWSTPHSYFSLTFCVQVQGKSKREKKDRVFTDKTSATVICRKNASISVRAQDRYYSSSWSEWASVPCS/GGGGSGGGG
SGGGGSGGGGSGGGGS/RNLPVATPDPGMFPCLHHSQNLLRAVSNMLQKARQTLEFYPCTSEEIDHEDITKDKTSTVEA
CLPLELTKNESCLNSRETSFITNGSCLASRKTSFMMALCLSSIYEDLKMYQVEFKTMNAKLLMDPKRQIFLDQNMLAVI
DELMQALNFNSETVPQKSSLEEPDFYKTKIKLCILLHAFRIRAVTIDRVMSYLNAS/GGGGSGGGGS/EPKSSDKTHTC
PPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVLHEALHSHYTQKSLSLSPGK Chain 2 - mAb C[PD-1]_H1_IgG1_PVA_/S267K/S364K/E357Q/M428L/N434S (SEQ ID NO: 737)
EVQLVESGGGLVQPGGSLRLSCAASGFTFSSFGMHWVRQAPGKGLEWVSYISSGSSIIYYADSVKGRFTISRDNAKNSL
YLQMNSLRAEDTAVYYCARGGRLVWSPDYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAPPV
AGPSVFLFPPKPKDTLMISRTPEVTCVVVDVKHEDPEVKFNWYVDGVEVHNAKTKPREEQYNSTYRVVSVLTVLHQDWL
NGKEYKCKVSNKALPAPIEKTISKAKGQPREPQVYTLPPSREQMTKNQVKLTCLVKGFYPSDIAVEWESNGQPENNYKT
TPPVLDSDGSFFLYSKLTVDKSRWQQGNVFSCSVLHEALHSHYTQKSLSLSPGK Chain 3 - mAb C[PD-1]_L1.1 (SEQ ID NO: 732)
DIVMTQSPDSLAVSLGERATINCKSSQSLLHSGNQKNYLTWYQQKPGQPPKLLIYWASTRESGVPDRFTGSGSGTDFTL
TISSLQAEDVAVYYCQNDYSYPFTFGSGTKLEIK/RTVAAPSVFIFPPSDEQLKSGTASVVCLLNNFYPREAKVQWKVD
NALQSGNSQESVTEQDSKDSTYSLSSTLTLSKADYEKHKVYACEVTHQGLSSPVTKSFNRGEC

Figure 80F

<u>>XENP31460 human_IL12p40_E59K/K99Y_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S-IgG1_PVA_/S267K/S364K/E357Q</u>

Chain 1 - human_IL12p40_E59K/K99Y_(GGGGS)5-human_IL12p35_(GGGGS)2_(single-chain)_Fc(216)_IgG1_pI(-)_Isosteric_A_C220S/PVA_/S267K/L368D/K370S (SEQ ID NO: 740)
*IWELKKDVYVVELDWYPDAPGEMVVLTCDTPEEDGITWTLDQSSEVLGSGKTLTIQVKKFGDAGQYTCHKGGEVLSHSL
LLLHKKEDGIWSTDILKDQYEPKNKTFLRCEAKNYSGRFTCWWLTTISTDLTFSVKSSRGSSDPQGVTCGAATLSAERV
RGDNKEYEYSVECQEDSACPAAEESLPIEVMVDAVHKLKYENYTSSFFIRDIIKPDPPKNLQLKPLKNSRQVEVSWEYP
DTWSTPHSYFSLTFCVQVQGKSKREKKDRVFTDKTSATVICRKNASISVRAQDRYYSSSWSEWASVPCS/*<u>GGGGSGGGG
SGGGGSGGGGSGGGGS</u>*/RNLPVATPDPGMFPCLHHSQNLLRAVSNMLQKARQTLEFYPCTSEEIDHEDITKDKTSTVEA
CLPLELTKNESCLNSRETSFITNGSCLASRKTSFMMALCLSSIYEDLKMYQVEFKTMNAKLLMDPKRQIFLDQNMLAVI
DELMQALNFNSETVPQKSSLEEPDFYKTKIKLCILLHAFRIRAVTIDRVMSYLNAS/*<u>GGGGSGGGGS</u>*/EPKSSDKTHTC
PPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK*

Chain 2 - mAb C[PD-1]_H1IgG1_PVA_/S267K/S364K/E357Q (SEQ ID NO: 727)
EVQLVESGGGLVQPGGSLRLSCAASGFTFSS<u>FGMH</u>WVRQAPGKGLEWVSY<u>ISSGSSIIYYADSVK</u>GRFTISRDNAKNSL
YLQMNSLRAEDTAVYYCAR<u>GGRLVWSPDY</u>WGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAPPV
AGPSVFLFPPKPKDTLMISRTPEVTCVVVDVKHEDPEVKFNWYVDGVEVHNAKTKPREEQYNSTYRVVSVLTVLHQDWL
NGKEYKCKVSNKALPAPIEKTISKAKGQPREPQVYTLPPSREQMTKNQVKLTCLVKGFYPSDIAVEWESNGQPENNYKT
TPPVLDSDGSFFLYSKLTVDKSRWQQGNVFSCSVMHEALHNHYTQKSLSLSPGK

Chain 3 - mAb C[PD-1]_L1.1 (SEQ ID NO: 732)
DIVMTQSPDSLAVSLGERATINCK<u>SSQSLLHSGNQKNYLT</u>WYQQKPGQPPKLLIY<u>WASTRES</u>GVPDRFTGSGSGTDFTL
TISSLQAEDVAVYYC<u>QNDYSYPFT</u>FGSGTKLEIK/RTVAAPSVFIFPPSDEQLKSGTASVVCLLNNFYPREAKVQWKVD
NALQSGNSQESVTEQDSKDSTYSLSSTLTLSKADYEKHKVYACEVTHQGLSSPVTKSFNRGEC <u>>XENP31461 human_IL12p40_D18K/E59K/K99E_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S-IgG1_PVA_/S267K/S364K/E357Q</u>

Chain 1 - human_IL12p40_D18K/E59K/K99E_(GGGGS)5-human_IL12p35_(GGGGS)2_(single-chain)_Fc(216)_IgG1_pI(-)_Isosteric_A_C220S/PVA_/S267K/L368D/K370S (SEQ ID NO: 741)
*IWELKKDVYVVELDWYPKAPGEMVVLTCDTPEEDGITWTLDQSSEVLGSGKTLTIQVKKFGDAGQYTCHKGGEVLSHSL
LLLHKKEDGIWSTDILKDQEEPKNKTFLRCEAKNYSGRFTCWWLTTISTDLTFSVKSSRGSSDPQGVTCGAATLSAERV
RGDNKEYEYSVECQEDSACPAAEESLPIEVMVDAVHKLKYENYTSSFFIRDIIKPDPPKNLQLKPLKNSRQVEVSWEYP
DTWSTPHSYFSLTFCVQVQGKSKREKKDRVFTDKTSATVICERKNASISVRAQDRYYSSSWSEWASVPCS/*<u>GGGGSGGGG
SGGGGSGGGGSGGGGS</u>*/RNLPVATPDPGMFPCLHHSQNLLRAVSNMLQKARQTLEFYPCTSEEIDHEDITKDKTSTVEA
CLPLELTKNESCLNSRETSFITNGSCLASRKTSFMMALCLSSIYEDLKMYQVEFKTMNAKLLMDPKRQIFLDQNMLAVI
DELMQALNFNSETVPQKSSLEEPDFYKTKIKLCILLHAFRIRAVTIDRVMSYLNAS/*<u>GGGGSGGGGS</u>*/EPKSSDKTHTC
PPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK*

Chain 2 - mAb C[PD-1]_H1IgG1_PVA_/S267K/S364K/E357Q (SEQ ID NO: 727)
EVQLVESGGGLVQPGGSLRLSCAASGFTFSS<u>FGMH</u>WVRQAPGKGLEWVSY<u>ISSGSSIIYYADSVK</u>GRFTISRDNAKNSL
YLQMNSLRAEDTAVYYCAR<u>GGRLVWSPDY</u>WGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAPPV
AGPSVFLFPPKPKDTLMISRTPEVTCVVVDVKHEDPEVKFNWYVDGVEVHNAKTKPREEQYNSTYRVVSVLTVLHQDWL
NGKEYKCKVSNKALPAPIEKTISKAKGQPREPQVYTLPPSREQMTKNQVKLTCLVKGFYPSDIAVEWESNGQPENNYKT
TPPVLDSDGSFFLYSKLTVDKSRWQQGNVFSCSVMHEALHNHYTQKSLSLSPGK

Chain 3 - mAb C[PD-1]_L1.1 (SEQ ID NO: 732)
DIVMTQSPDSLAVSLGERATINCK<u>SSQSLLHSGNQKNYLT</u>WYQQKPGQPPKLLIY<u>WASTRES</u>GVPDRFTGSGSGTDFTL
TISSLQAEDVAVYYC<u>QNDYSYPFT</u>FGSGTKLEIK/RTVAAPSVFIFPPSDEQLKSGTASVVCLLNNFYPREAKVQWKVD
NALQSGNSQESVTEQDSKDSTYSLSSTLTLSKADYEKHKVYACEVTHQGLSSPVTKSFNRGEC

Figure 80G

>XENP31462 human_IL12p40_E59K/K99E/K264E_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S-IgG1_PVA_/S267K/S364K/E357Q Chain 1 - human_IL12p40_E59K/K99E/K264E_(GGGGS)5-human_IL12p35_(GGGGS)2_(single-chain)_Fc(216)_IgG1_pI(-)_Isosteric_A_C220S/PVA_/S267K/L368D/K370S (SEQ ID NO: 742)
IWELKKDVYVVELDWYPDAPGEMVVLTCDTPEEDGITWTLDQSSEVLGSGKTLTIQVKKFGDAGQYTCHKGGEVLSHSL
LLLHKKEDGIWSTDILKDQEEPKNKTFLRCEAKNYSGRFTCWWLTTISTDLTFSVKSSRGSSDPQGVTCGAATLSAERV
RGDNKEYEYSVECQEDSACPAAEESLPIEVMVDAVHKLKYENYTSSFFIRDIIKPDFPKNLQLKPLKNSRQVEVSWEYP
DTWSTPHSYFSLTFCVQVQGKSKREKEDRVFTDKTSATVICRKNASISVRAQDRYYSSSWSEWASVPCS/GGGGSGGGG
SGGGGSGGGGSGGGGS/RNLPVATPDPGMFPCLHHSQNLLRAVSNMLQKARQTLEFYPCTSEEIDHEDITKDKTSTVEA
CLPLELTKNESCLNSRETSFITNGSCLASRKTSFMMALCLSSIYEDLKMYQVEFKTMNAKLLMDPKRQIFLDQNMLAVI
DELMQALNFNSETVPQKSSLEEPDFYKTKIKLCILLHAFRIRAVTIDRVMSYLNAS/GGGGSGGGGS/EPKSSDKTHTC
PPCPAPPVAGPSVFLFPPKPKDTLMISRTPEVTCVVVDVSKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK Chain 2 - mAb C[PD-1]_H1IgG1_PVA_/S267K/S364K/E357Q (SEQ ID NO: 727)
EVQLVESGGGLVQPGGSLRLSCAASGFTFSSFGMHWVRQAPGKGLEWVSYISSGSSIIYYADSVKGRFTISRDNAKNSL
YLQMNSLRAEDTAVYYCARGGPLVWSPDYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAPPV
AGPSVFLFPPKPKDTLMISRTPEVTCVVVDVSHEDPEVKFNWYVDGVEVHNAKTKPREEQYNSTYRVVSVLTVLHQDWL
NGKEYKCKVSNKALPAPIEKTISKAKGQPREPQVYTLPPSREQMTKNQVKLTCLVKGFYPSDIAVEWESNGQPENNYKT
TPPVLDSDGSFFLYSKLTVDKSRWQQGNVFSCSVMHEALHNHYTQKSLSLSPGK Chain 3 - mAb C[PD-1]_L1.1 (SEQ ID NO: 732)
DIVMTQSPDSLAVSLGERATINCKSSQSLLHSGNQKNYLTWYQQKPGQPPKLLIYWASTRESGVPDRFTGSGSGTDFTL
TISSLQAEDVAVYYCQNDYSYPFTFGSGTKLEIK/RTVAAPSVFIFPPSDEQLKSGTASVVCLLNNFYPREAKVQWKVD
NALQSGNSQESVTEQDSKDSTYSLSSTLTLSKADYEKHKVYACEVTHQGLSSPVTKSFNRGEC >XENP31585 human_IL12p40_E59K/K99E/K264E_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S Chain 1 - human_IL12p40_E59K/K99E/K264E_(GGGGS)5-human_IL12p35_(GGGGS)2_(single-chain)_Fc(216)_IgG1_pI(-)_Isosteric_A_C220S/PVA_/S267K/L368D/K370S/M428L/N434S (SEQ ID NO: 743)
IWELKKDVYVVELDWYPDAPGEMVVLTCDTPEEDGITWTLDQSSEVLGSGKTLTIQVKKFGDAGQYTCHKGGEVLSHSL
LLLHKKEDGIWSTDILKDQEEPKNKTFLRCEAKNYSGRFTCWWLTTISTDLTFSVKSSRGSSDPQGVTCGAATLSAERV
RGDNKEYEYSVECQEDSACPAAEESLPIEVMVDAVHKLKYENYTSSFFIRDIIKPDFPKNLQLKPLKNSRQVEVSWEYP
DTWSTPHSYFSLTFCVQVQGKSKREKEDRVFTDKTSATVICRKNASISVRAQDRYYSSSWSEWASVPCS/GGGGSGGGG
SGGGGSGGGGSGGGGS/RNLPVATPDPGMFPCLHHSQNLLRAVSNMLQKARQTLEFYPCTSEEIDHEDITKDKTSTVEA
CLPLELTKNESCLNSRETSFITNGSCLASRKTSFMMALCLSSIYEDLKMYQVEFKTMNAKLLMDPKRQIFLDQNMLAVI
DELMQALNFNSETVPQKSSLEEPDFYKTKIKLCILLHAFRIRAVTIDRVMSYLNAS/GGGGSGGGGS/EPKSSDKTHTC
PPCPAPPVAGPSVFLFPPKPKDTLMISRTPEVTCVVVDVSKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVLHEALHSHYTQKSLSLSPGK Chain 2 - mAb C[PD-1]_H1_IgG1_C220S/PVA_/S267K/S364K/E357Q/M428L/N434S (SEQ ID NO: 744)
EVQLVESGGGLVQPGGSLRLSCAASGFTFSSFGMHWVRQAPGKGLEWVSYISSGSSIIYYADSVKGRFTISRDNAKNSL
YLQMNSLRAEDTAVYYCARGGPLVWSPDYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAPPV
AGPSVFLFPPKPKDTLMISRTPEVTCVVVDVSHEDPEVKFNWYVDGVEVHNAKTKPREEQYNSTYRVVSVLTVLHQDWL
NGKEYKCKVSNKALPAPIEKTISKAKGQPREPQVYTLPPSREQMTKNQVKLTCLVKGFYPSDIAVEWESNGQPENNYKT
TPPVLDSDGSFFLYSKLTVDKSRWQQGNVFSCSVLHEALHSHYTQKSLSLSPGK Chain 3 - mAb C[PD-1]_L1.1 (SEQ ID NO: 732)
DIVMTQSPDSLAVSLGERATINCKSSQSLLHSGNQKNYLTWYQQKPGQPPKLLIYWASTRESGVPDRFTGSGSGTDFTL
TISSLQAEDVAVYYCQNDYSYPFTFGSGTKLEIK/RTVAAPSVFIFPPSDEQLKSGTASVVCLLNNFYPREAKVQWKVD
NALQSGNSQESVTEQDSKDSTYSLSSTLTLSKADYEKHKVYACEVTHQGLSSPVTKSFNRGEC

Figure 80H

>XENP31586 human_IL12p40_E59K/K99Y_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S Chain 1 - human_IL12p40_E59K/K99Y_(GGGGS)5-human_IL12p35_(GGGGS)2_(single-chain)_Fc(216)_IgG1_pI(-)_Isosteric_A_C220S/PVA_/S267K/L368D/K370S/M428L/N434S (SEQ ID NO: 745)

*IWELKKDVYVVELDWYPDAPGEMVVLTCDTPEEDGITWTLDQSSEVLGSGKTLTIQVKKFGDAGQYTCHKGGEVLSHSL
LLHKKEDGIWSTDILKDQYEPKNKTFLRCEAKNYSGRFTCWWLTTISTDLTFSVKSSRGSSDPQGVTCGAATLSAERV
RGDNKEYEYSVECQEDSACPAAEESLPIEVMVDAVHKLKYENYTSSFFIRDIIKPDPPKNLQLKPLKNSRQVEVSWEYP
DTWSTPHSYFSLTFCVQVQGKSKREKKDRVFTDKTSATVICRKNASISVRAQDRYYSSSWSEWASVPCS*/GGGGSGGGG
SGGGGSGGGGSGGGGS/RNLPVATPDPGMFPCLHHSQNLLRAVSNMLQKARQTLEFYPCTSEEIDHEDITKDKTSTVEA
CLPLELTKNESCLNSRETSFITNGSCLASRKTSFMMALCLSSIYEDLKMYQVEFKTMNAKLLMDPKRQIFLDQNMLAVI
DELMQALNFNSETVPQKSSLEEPDFYKTKIKLCILLHAFRIRAVTIDRVMSYLNAS/GGGGSGGGGS/EPKSSDKTHTC
PPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVLHEALHSHYTQKSLSLSPGK*

Chain 2 - mAb C[PD-1]_H1_IgG1_C220S/PVA_/S267K/S364K/E357Q/M428L/N434S (SEQ ID NO: 744)

EVQLVESGGGLVQPGGSLRLSCAASGFTFSSFGMHWVRQAPGKGLEWVSYISSGSSIIYYADSVKGRFTISRDNAKNSL
YLQMNSLRAEDTAVYYCARGGRLVWSPDYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAPPV
AGPSVFLFPPKPKDTLMISRTPEVTCVVVDVKHEDPEVKFNWYVDGVEVHNAKTKPREEQYNSTYRVVSVLTVLHQDWL
NGKEYKCKVSNKALPAPIEKTISKAKGQPREPQVYTLPPSREQMTKNQVKLTCLVKGFYPSDIAVEWESNGQPENNYKT
TPPVLDSDGSFFLYSKLTVDKSRWQQGNVFSCSVLHEALHSHYTQKSLSLSPGK

Chain 3 - mAb C[PD-1]_L1.1 (SEQ ID NO: 732)

DIVMTQSPDSLAVSLGERATINCKSSQSLLHSGNQKNYLTWYQQKPGQPPKLLIYWASTRESGVPDRFTGSGSGTDFTL
TISSLQAEDVAVYYCQNDYSYPFTFGSGTKLEIK/RTVAAPSVFIFPPSDEQLKSGTASVVCLLNNFYPREAKVQWKVD
NALQSGNSQESVTEQDSKDSTYSLSSTLTLSKADYEKHKVYACEVTHQGLSSPVTKSFNRGEC

>XENP32192 human_IL12p40_D18K/E59K/K99E/K264E_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S-IgG1_PVA_/S267K/S364K/E357Q Chain 1 - human_IL12p40_D18K/E59K/K99E/K264E_(GGGGS)5-human_IL12p35_(GGGGS)2_(single-chain)_Fc(216)_IgG1_pI(-)_Isosteric_A_C220S/PVA_/S267K/L368D/K370S (SEQ ID NO: 746)

*IWELKKDVYVVELDWYPKAPGEMVVLTCDTPEEDGITWTLDQSSEVLGSGKTLTIQVKKFGDAGQYTCHKGGEVLSHSL
LLHKKEDGIWSTDILKDQEEPKNKTFLRCEAKNYSGRFTCWWLTTISTDLTFSVKSSRGSSDPQGVTCGAATLSAERV
RGDNKEYEYSVECQEDSACPAAEESLPIEVMVDAVHKLKYENYTSSFFIRDIIKPDPPKNLQLKPLKNSRQVEVSWEYP
DTWSTPHSYFSLTFCVQVQGKSKREKEDRVFTDKTSATVICRKNASISVRAQDRYYSSSWSEWASVPCS*/GGGGSGGGG
SGGGGSGGGGSGGGGS/RNLPVATPDPGMFPCLHHSQNLLRAVSNMLQKARQTLEFYPCTSEEIDHEDITKDKTSTVEA
CLPLELTKNESCLNSRETSFITNGSCLASRKTSFMMALCLSSIYEDLKMYQVEFKTMNAKLLMDPKRQIFLDQNMLAVI
DELMQALNFNSETVPQKSSLEEPDFYKTKIKLCILLHAFRIRAVTIDRVMSYLNAS/GGGGSGGGGS/EPKSSDKTHTC
PPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK*

Chain 2 - mAb C[PD-1]_H1IgG1_PVA_/S267K/S364K/E357Q (SEQ ID NO: 727)

EVQLVESGGGLVQPGGSLRLSCAASGFTFSSFGMHWVRQAPGKGLEWVSYISSGSSIIYYADSVKGRFTISRDNAKNSL
YLQMNSLRAEDTAVYYCARGGRLVWSPDYWGQGTLVTVSS/ASTKGPSVFPLAPSSKSTSGGTAALGCLVKDYFPEPVT
VSWNSGALTSGVHTFPAVLQSSGLYSLSSVVTVPSSSLGTQTYICNVNHKPSNTKVDKKVEPKSCDKTHTCPPCPAPPV
AGPSVFLFPPKPKDTLMISRTPEVTCVVVDVKHEDPEVKFNWYVDGVEVHNAKTKPREEQYNSTYRVVSVLTVLHQDWL
NGKEYKCKVSNKALPAPIEKTISKAKGQPREPQVYTLPPSREQMTKNQVKLTCLVKGFYPSDIAVEWESNGQPENNYKT
TPPVLDSDGSFFLYSKLTVDKSRWQQGNVFSCSVMHEALHNHYTQKSLSLSPGK

Chain 3 - mAb C[PD-1]_L1.1 (SEQ ID NO: 732)

DIVMTQSPDSLAVSLGERATINCKSSQSLLHSGNQKNYLTWYQQKPGQPPKLLIYWASTRESGVPDRFTGSGSGTDFTL
TISSLQAEDVAVYYCQNDYSYPFTFGSGTKLEIK/RTVAAPSVFIFPPSDEQLKSGTASVVCLLNNFYPREAKVQWKVD
NALQSGNSQESVTEQDSKDSTYSLSSTLTLSKADYEKHKVYACEVTHQGLSSPVTKSFNRGEC

Figure 80I

>XENP32193 human_IL12p40_D18K/E59K/K99E/C252S_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S-IgG1_PVA_/S267K/S364K/E357Q

Chain 1 - human_IL12p40_D18K/E59K/K99E/C252S_(GGGGS)5-human_IL12p35_(GGGGS)2_(single-chain)_Fc(216)_IgG1_pI(-)_Isosteric_A_C220S/PVA_/S267K/L368D/K370S (SEQ ID NO: 747)

IWELKKDVYVVELDWYPKAPGEMVVLTCDTPEEDGITWTLDQSSEVLGSGKTLTIQVKKFGDAGQYTCHKGGEVLSHSLLLLH
KKEDGIWSTDILKDQEEPKNKTFLRCEAKNYSGRFTCWWLTTISTDLTFSVKSSRGSSDPQGVTCGAATLSAERVRGDNKEYE
YSVECQEDSACPAAEESLPIEVMVDAVHKLKYENYTSSFFIRDIIKPDPPKNLQLKPLKNSRQVEVSWEYPDTWSTPHSYFSL
TFSVQVQGKSKREKKDRVFTDKTSATVICRKNASISVRAQDRYYSSSWSEWASVPCS/GGGGSGGGGSGGGGSGGGGSGGGGS
/RNLPVATPDPGMFPCLHHSQNLLRAVSNMLQKARQTLEFYPCTSEEIDHEDITKDKTSTVEACLPLELTKNESCLNSRETSF
ITNGSCLASRKTSFMMALCLSSIYEDLKMYQVEFKTMNAKLLMDPKRQIFLDQNMLAVIDELMQALNFNSETVPQKSSLEEPD
FYKTKIKLCILLHAFRIRAVTIDRVMSYLNAS/GGGGSGGGGS/EPKSSDKTHTCPPCPAPPVAGPSVFLFPPKPKDTLMISR
TPEVTCVVVDVKHEDPEVKFNWYVDGVEVHNAKTKPREEEYNSTYRVVSVLTVLHQDWLNGKEYKCKVSNKALPAPIEKTISK
AKGQPREPQVYTLPPSREEMTKNQVSLTCDVSGFYPSDIAVEWESDGQPENNYKTTPPVLDSDGSFFLYSKLTVDKSRWEQGD
VFSCSVMHEALHNHYTQKSLSLSPGK

Chain 2 - mAb C[PD-1]_H1IgG1_PVA_/S267K/S364K/E357Q (SEQ ID NO: 727)

EVQLVESGGGLVQPGGSLRLSCAASGFTFSSFGMHWVRQAPGKGLEWVSYISSGSSIIYYADSVKGRFTISRDNAKNSLYLQM
NSLRAEDTAVYYCARGGKLVWSPDYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPKP
KDTLMISRTPEVTCVVVDVKHEDPEVKFNWYVDGVEVHNAKTKPREEQYNSTYRVVSVLTVLHQDWLNGKEYKCKVSNKALPA
PIEKTISKAKGQPREPQVYTLPPSREQMTKNQVKLTCLVKGFYPSDIAVEWESNGQPENNYKTTPPVLDSDGSFFLYSKLTVD
KSRWQQGNVFSCSVMHEALHNHYTQKSLSLSPGK

Chain 3 - mAb C[PD-1]_L1.1 (SEQ ID NO: 732)

DIVMTQSPDSLAVSLGERATINCKSSQSLLHSGNQKNYLTWYQQKPGQPPKLLIYWASTRESGVPDRFTGSGSGTDFTLTISS
LQAEDVAVYYCQNDYSYPFTFGSGTKLEIK/RTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

>XENP32194 human_IL12p40_D18K/E59K/K99E/C252S/K264E_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S-IgG1_PVA_/S267K/S364K/E357Q

Chain 1 - human_IL12p40_D18K/E59K/K99E/C252S/K264E_(GGGGS)5-human_IL12p35_(GGGGS)2_(single-chain)_Fc(216)_IgG1_pI(-)_Isosteric_A_C220S/PVA_/S267K/L368D/K370S (SEQ ID NO: 749)

IWELKKDVYVVELDWYPKAPGEMVVLTCDTPEEDGITWTLDQSSEVLGSGKTLTIQVKKFGDAGQYTCHKGGEVLSHSLLLLH
KKEDGIWSTDILKDQEEPKNKTFLRCEAKNYSGRFTCWWLTTISTDLTFSVKSSRGSSDPQGVTCGAATLSAERVRGDNKEYE
YSVECQEDSACPAAEESLPIEVMVDAVHKLKYENYTSSFFIRDIIKPDPPKNLQLKPLKNSRQVEVSWEYPDTWSTPHSYFSL
TFSVQVQGKSKREKEDRVFTDKTSATVICRKNASISVRAQDRYYSSSWSEWASVPCS/GGGGSGGGGSGGGGSGGGGSGGGGS
/RNLPVATPDPGMFPCLHHSQNLLRAVSNMLQKARQTLEFYPCTSEEIDHEDITKDKTSTVEACLPLELTKNESCLNSRETSF
ITNGSCLASRKTSFMMALCLSSIYEDLKMYQVEFKTMNAKLLMDPKRQIFLDQNMLAVIDELMQALNFNSETVPQKSSLEEPD
FYKTKIKLCILLHAFRIRAVTIDRVMSYLNAS/GGGGSGGGGS/EPKSSDKTHTCPPCPAPPVAGPSVFLFPPKPKDTLMISR
TPEVTCVVVDVKHEDPEVKFNWYVDGVEVHNAKTKPREEEYNSTYRVVSVLTVLHQDWLNGKEYKCKVSNKALPAPIEKTISK
AKGQPREPQVYTLPPSREEMTKNQVSLTCDVSGFYPSDIAVEWESDGQPENNYKTTPPVLDSDGSFFLYSKLTVDKSRWEQGD
VFSCSVMHEALHNHYTQKSLSLSPGK

Chain 2 - mAb C[PD-1]_H1IgG1_PVA_/S267K/S364K/E357Q (SEQ ID NO: 727)

EVQLVESGGGLVQPGGSLRLSCAASGFTFSSFGMHWVRQAPGKGLEWVSYISSGSSIIYYADSVKGRFTISRDNAKNSLYLQM
NSLRAEDTAVYYCARGGKLVWSPDYWGQGTLVTVSS/ASTKGPSVFPLAPSSKSTSGGTAALGCLVKDYFPEPVTVSWNSGAL
TSGVHTFPAVLQSSGLYSLSSVVTVPSSSLGTQTYICNVNHKPSNTKVDKKVEPKSCDKTHTCPPCPAPPVAGPSVFLFPPKP
KDTLMISRTPEVTCVVVDVKHEDPEVKFNWYVDGVEVHNAKTKPREEQYNSTYRVVSVLTVLHQDWLNGKEYKCKVSNKALPA
PIEKTISKAKGQPREPQVYTLPPSREQMTKNQVKLTCLVKGFYPSDIAVEWESNGQPENNYKTTPPVLDSDGSFFLYSKLTVD
KSRWQQGNVFSCSVMHEALHNHYTQKSLSLSPGK

Chain 3 - mAb C[PD-1]_L1.1 (SEQ ID NO: 732)

DIVMTQSPDSLAVSLGERATINCKSSQSLLHSGNQKNYLTWYQQKPGQPPKLLIYWASTRESGVPDRFTGSGSGTDFTLTISS
LQAEDVAVYYCQNDYSYPFTFGSGTKLEIK/RTVAAPSVFIFPPSDEQLKSGTASVVCLLNNFYPREAKVQWKVDNALQSGNS
QESVTEQDSKDSTYSLSSTLTLSKADYEKHKVYACEVTHQGLSSPVTKSFNRGEC

Figure 80J

>XENP32195 human_IL12p40_E59K/K99E/C252S/K264E_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S-IgG1_PVA_/S267K/S364K/E357Q Chain 1 - human_IL12p40_E59K/K99E/C252S/K264E_(GGGGS)5-human_IL12p35_(GGGGS)2_(single-chain)_Fc(216)_IgG1_pI(-)_Isosteric_A_C220S/PVA_/S267K/L368D/K370S (SEQ ID NO: 750)
*IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK*

Chain 2 - mAb C[PD-1]_H1IgG1_PVA_/S267K/S364K/E357Q (SEQ ID NO: 727)
EVQLVESGGGLVQPGGSLRLSCAASGFTFSSFGMHWVRQAPGKGLEWVSYISSGSSIIYYADSVKGRFTISRDNA
KNSLYLQMNSLRAEDTAVYYCARGGRLVWSPDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVMHEALHNHYTQKSLSLSPGK Chain 3 - mAb C[PD-1]_L1.1 (SEQ ID NO: 732)
DIVMTQSPDSLAVSLGERATINCKSSQSLLHSGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC

Figure 81A

>XENP31108 human_IL12p40_E59K/K99E_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S-IgG1_PVA_/S267K/S364K/E357Q

Chain 1 - human_IL12p40_E59K/K99E_(GGGGS)5-human_IL12p35_(GGGGS)2_(single-chain)_Fc(216)_IgG1_pI(-)_Isosteric_A_C220S/PVA_/S267K/L368D/K370S (SEQ ID NO: 735)

*IWELKKDVYVVELDWYPDAPGEMVVLTCDTPEEDGITWTLDQSSEVLGSGKTLTIQVKKFGDAGQYTCHKGGEVLSHSL*
*LLLHKKEDGIWSTDILKDQEEPKNKTFLRCEAKNYSGRFTCWWLTTISTDLTFSVKSSRGSSDPQGVTCGAATLSAERV*
*RGDNKEYEYSVECQEDSACPAAEESLPIEVMVDAVHKLKYENYTSSFFIRDIIKPDPPKNLQLKPLKNSRQVEVSWEYP*
*DTWSTPHSYFSLTFCVQVQGKSKREKKDRVFTDKTSATVICRKNASISVRAQDRYYSSSWSEWASVPCS/GGGGSGGGG*
*SGGGGSGGGGSGGGGS/RNLPVATPDPGMFPCLHHSQNLLRAVSNMLQKARQTLEFYPCTSEEIDHEDITKDKTSTVEA*
*CLPLELTKNESCLNSRETSFITNGSCLASRKTSFMMALCLSSIYEDLKMYQVEFKTMNAKLLMDPKRQIFLDQNMLAVI*
*DELMQALNFNSETVPQKSSLEEPDFYKTKIKLCILLHAFRIRAVTIDRVMSYLNAS/GGGGSGGGGS/EPKSSDKTHTC*
PPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK

Chain 2 - YW243.55.S70[PD-L1]_H0_IgG1_PVA_/S267K/S364K/E357Q (SEQ ID NO: 751)

EVQLVESGGGLVQPGGSLRLSCAASGFTFSDSWIHWVRQAPGKGLEWVAWISPYGGSTYYADSVKGRFTISADTSKNTA
YLQMNSLRAEDTAVYYCARRHWPGGFDYWGQGTLVTVSS/ASTKGPSVFPLAPSSKSTSGGTAALGCLVKDYFPEPVTV
SWNSGALTSGVHTFPAVLQSSGLYSLSSVVTVPSSSLGTQTYICNVNHKPSNTKVDKKVEPKSCDKTHTCPPCPAPPVA
GPSVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYKTT
PPVLDSDGSFFLYSKLTVDKSRWQQGNVFSCSVMHEALHNHYTQKSLSLSPGK

Chain 3 - YW243.55.S70[PD-L1]_L0 (SEQ ID NO: 752)

DIQMTQSPSSLSASVGDRVTITCRASQDVSTAVAWYQQKPGKAPKLLIYSASFLYSGVPSRFSGSGSGTDFTLTISSLQ
PEDFATYYCQQYLYHPATFGQGTKVEIK/RTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC

>XENP31463 human_IL12p40_E59K/K99Y_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S-IgG1_PVA_/S267K/S364K/E357Q

Chain 1 - human_IL12p40_E59K/K99Y_(GGGGS)5-human_IL12p35_(GGGGS)2_(single-chain)_Fc(216)_IgG1_pI(-)_Isosteric_A_C220S/PVA_/S267K/L368D/K370S (SEQ ID NO: 740)

*IWELKKDVYVVELDWYPDAPGEMVVLTCDTPEEDGITWTLDQSSEVLGSGKTLTIQVKKFGDAGQYTCHKGGEVLSHSL*
*LLLHKKEDGIWSTDILKDQYEPKNKTFLRCEAKNYSGRFTCWWLTTISTDLTFSVKSSRGSSDPQGVTCGAATLSAERV*
*RGDNKEYEYSVECQEDSACFAAEESLPIEVMVDAVHKLKYENYTSSFFIRDIIKPDPPKNLQLKPLKNSRQVEVSWEYP*
*DTWSTPHSYFSLTFCVQVQGKSKREKKDRVFTDKTSATVICRKNASISVRAQDRYYSSSWSEWASVPCS/GGGGSGGGG*
*SGGGGSGGGGSGGGGS/RNLPVATPDPGMFPCLHHSQNLLRAVSNMLQKARQTLEFYPCTSEEIDHEDITKDKTSTVEA*
*CLPLELTKNESCLNSRETSFITNGSCLASRKTSFMMALCLSSIYEDLKMYQVEFKTMNAKLLMDPKRQIFLDQNMLAVI*
*DELMQALNFNSETVPQKSSLEEPDFYKTKIKLCILLHAFRIRAVTIDRVMSYLNAS/GGGGSGGGGS/EPKSSDKTHTC*
PPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK

Chain 2 - YW243.55.S70[PD-L1]_H0_IgG1_PVA_/S267K/S364K/E357Q (SEQ ID NO: 751)

EVQLVESGGGLVQPGGSLRLSCAASGFTFSDSWIHWVRQAPGKGLEWVAWISPYGGSTYYADSVKGRFTISADTSKNTA
YLQMNSLRAEDTAVYYCARRHWPGGFDYWGQGTLVTVSS/ASTKGPSVFPLAPSSKSTSGGTAALGCLVKDYFPEPVTV
SWNSGALTSGVHTFPAVLQSSGLYSLSSVVTVPSSSLGTQTYICNVNHKPSNTKVDKKVEPKSCDKTHTCPPCPAPPVA
GPSVFLFPPKPKDTLMISRTPEVTCVVVDVKHEDPEVKFNWYVDGVEVHNAKTKPREEQYNSTYRVVSVLTVLHQDWLN
GKEYKCKVSNKALPAPIEKTISKAKGQPREPQVYTLPPSREQMTKNQVKLTCLVKGFYPSDIAVEWESNGQPENNYKTT
PPVLDSDGSFFLYSKLTVDKSRWQQGNVFSCSVMHEALHNHYTQKSLSLSPGK

Chain 3 - YW243.55.S70[PD-L1]_L0 (SEQ ID NO: 752)

DIQMTQSPSSLSASVGDRVTITCRASQDVSTAVAWYQQKPGKAPKLLIYSASFLYSGVPSRFSGSGSGTDFTLTISSLQ
PEDFATYYCQQYLYHPATFGQGTKVEIK/RTVAAPSVFIFPPSDEQLKSGTASVVCLLNNFYPREAKVQWKVDNALQSG
NSQESVTEQDSKDSTYSLSSTLTLSKADYEKHKVYACEVTHQGLSSPVTKSFNRGEC

Figure 81B

>XENP31464_human_IL12p40_D18K/E59K/K99E_(GGGGS)5-human_IL12p35_(GGGGS)2_(single-chain)-
YW243.55.S70[PD-L1]_H0L0_Fc(216)_IgG1_pI(-)_Isosteric_A_C220S/PVA_/S267K/L368D/K370S-
IgG1_PVA_/S267K/S364K/E357Q

Chain 1 - human_IL12p40_D18K/E59K/K99E_(GGGGS)5-human_IL12p35_(GGGGS)2_(single-chain)_Fc(216)_IgG1_pI(-)_Isosteric_A_C220S/PVA_/S267K/L368D/K370S (SEQ ID NO: 741)
IWELKKDVYVVELDWYPKAPGEMVVLTCDTPEEDGITWTLDQSSEVLGSGKTLTIQVKKFGDAGQYTCHKGGEVLSHSLLLLH
KKEDGIWSTDILKDQEEPKNKTFLRCEAKNYSGRFTCWWLTTISTDLTFSVKSSRGSSDPQGVTCGAATLSAERVRGDNKEYE
YSVECQEDSACPAAEESLPIEVMVDAVHKLKYENYTSSFFIRDIIKPDPPKNLQLKPLKNSRQVEVSWEYPDTWSTPHSYFSL
TFCVQVQGKSKREKKDRVFTDKTSATVICRKNASISVRAQDRYYSSSWSEWASVPCS/GGGGSGGGGSGGGGSGGGGSGGGGS
/RNLPVATPDPGMFPCLHHSQNLLRAVSNMLQKARQTLEFYPCTSEEIDHEDITKDKTSTVEACLPLELTKNESCLNSRETSF
ITNGSCLASRKTSFMMALCLSSIYEDLKMYQVEFKTMNAKLLMDPKRQIFLDQNMLAVIDELMQALNFNSETVPQKSSLEEPD
FYKTKIKLCILLHAFRIRAVTIDRVMSYLNAS/GGGGSGGGGS/EPKSSDKTHTCPPCPAPPVAGPSVFLFPPKPKDTLMISR
TPEVTCVVVDVKHEDPEVKFNWYVDGVEVHNAKTKPREEEYNSTYRVVSVLTVLHQDWLNGKEYKCKVSNKALPAPIEKTISK
AKGQPREPQVYTLPPSREEMTKNQVSLTCDVSGFYPSDIAVEWESDGQPENNYKTTPPVLDSDGSFFLYSKLTVDKSRWEQGD
VFSCSVMHEALHNHYTQKSLSLSPGK

Chain 2 - YW243.55.S70[PD-L1]_H0_IgG1_PVA_/S267K/S364K/E357Q (SEQ ID NO: 751)
EVQLVESGGGLVQPGGSLRLSCAASGFTFSDSWIHWVRQAPGKGLEWVAWISPYGGSTYYADSVKGRFTISADTSKNTAYLQM
NSLRAEDTAVYYCARRHWPGGFDYWGQGTLVTVSS/ASTKGPSVFPLAPSSKSTSGGTAALGCLVKDYFPEPVTVSWNSGALT
SGVHTFPAVLQSSGLYSLSSVVTVPSSSLGTQTYICNVNHKPSNTKVDKKVEPKSCDKTHTCPPCPAPPVAGPSVFLFPPKPK
DTLMISRTPEVTCVVVDVKHEDPEVKFNWYVDGVEVHNAKTKPREEQYNSTYRVVSVLTVLHQDWLNGKEYKCKVSNKALPAP
IEKTISKAKGQPREPQVYTLPPSREQMTKNQVKLTCLVKGFYPSDIAVEWESNGQPENNYKTTPPVLDSDGSFFLYSKLTVDK
SRWQQGNVFSCSVMHEALHNHYTQKSLSLSPGK

Chain 3 - YW243.55.S70[PD-L1]_L0 (SEQ ID NO: 752)
DIQMTQSPSSLSASVGDRVTITCRASQDVSTAVAWYQQKPGKAPKLLIYSASFLYSGVPSRFSGSGSGTDFTLTISSLQPEDF
ATYYCQQYLYHPATFGQGTKVEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC >XENP31465_human_IL12p40_E59K/K99E/K264E_(GGGGS)5-human_IL12p35_(GGGGS)2_(single-chain)-
YW243.55.S70[PD-L1]_H0L0_Fc(216)_IgG1_pI(-)_Isosteric_A_C220S/PVA_/S267K/L368D/K370S-
IgG1_PVA_/S267K/S364K/E357Q

Chain 1 - human_IL12p40_E59K/K99E/K264E_(GGGGS)5-human_IL12p35_(GGGGS)2_(single-chain)_Fc(216)_IgG1_pI(-)_Isosteric_A_C220S/PVA_/S267K/L368D/K370S (SEQ ID NO: 742)
IWELKKDVYVVELDWYPDAPGEMVVLTCDTPEEDGITWTLDQSSEVLGSGKTLTIQVKKFGDAGQYTCHKGGEVLSHSLLLLH
KKEDGIWSTDILKDQEEPKNKTFLRCEAKNYSGRFTCWWLTTISTDLTFSVKSSRGSSDPQGVTCGAATLSAERVRGDNKEYE
YSVECQEDSACPAAEESLPIEVMVDAVHKLKYENYTSSFFIRDIIKPDPPKNLQLKPLKNSRQVEVSWEYPDTWSTPHSYFSL
TFCVQVQGKSKREKEDRVFTDKTSATVICRKNASISVRAQDRYYSSSWSEWASVPCS/GGGGSGGGGSGGGGSGGGGSGGGGS
/RNLPVATPDPGMFPCLHHSQNLLRAVSNMLQKARQTLEFYPCTSEEIDHEDITKDKTSTVEACLPLELTKNESCLNSRETSF
ITNGSCLASRKTSFMMALCLSSIYEDLKMYQVEFKTMNAKLLMDPKRQIFLDQNMLAVIDELMQALNFNSETVPQKSSLEEPD
FYKTKIKLCILLHAFRIRAVTIDRVMSYLNAS/GGGGSGGGGS/EPKSSDKTHTCPPCPAPPVAGPSVFLFPPKPKDTLMISR
TPEVTCVVVDVKHEDPEVKFNWYVDGVEVHNAKTKPREEEYNSTYRVVSVLTVLHQDWLNGKEYKCKVSNKALPAPIEKTISK
AKGQPREPQVYTLPPSREEMTKNQVSLTCDVSGFYPSDIAVEWESDGQPENNYKTTPPVLDSDGSFFLYSKLTVDKSRWEQGD
VFSCSVMHEALHNHYTQKSLSLSPGK

Chain 2 - YW243.55.S70[PD-L1]_H0_IgG1_PVA_/S267K/S364K/E357Q (SEQ ID NO: 751)
EVQLVESGGGLVQPGGSLRLSCAASGFTFSDSWIHWVRQAPGKGLEWVAWISPYGGSTYYADSVKGRFTISADTSKNTAYLQM
NSLRAEDTAVYYCARRHWPGGFDYWGQGTLVTVSS/ASTKGPSVFPLAPSSKSTSGGTAALGCLVKDYFPEPVTVSWNSGALT
SGVHTFPAVLQSSGLYSLSSVVTVPSSSLGTQTYICNVNHKPSNTKVDKKVEPKSCDKTHTCPPCPAPPVAGPSVFLFPPKPK
DTLMISRTPEVTCVVVDVKHEDPEVKFNWYVDGVEVHNAKTKPREEQYNSTYRVVSVLTVLHQDWLNGKEYKCKVSNKALPAP
IEKTISKAKGQPREPQVYTLPPSREQMTKNQVKLTCLVKGFYPSDIAVEWESNGQPENNYKTTPPVLDSDGSFFLYSKLTVDK
SRWQQGNVFSCSVMHEALHNHYTQKSLSLSPGK

Chain 3 - YW243.55.S70[PD-L1]_L0 (SEQ ID NO: 752)
DIQMTQSPSSLSASVGDRVTITCRASQDVSTAVAWYQQKPGKAPKLLIYSASFLYSGVPSRFSGSGSGTDFTLTISSLQPEDF
ATYYCQQYLYHPATFGQGTKVEIK/RTVAAPSVFIFPPSDEQLKSGTASVVCLLNNFYPREAKVQWKVDNALQSGNSQESVTE
QDSKDSTYSLSSTLTLSKADYEKHKVYACEVTHQGLSSPVTKSFNRGEC

Figure 82A

>XENP29946 human_IL12p40_(GGGGS)5-human_IL12p35_(GGGGS)2_(single-chain)-
Numax_Fab_Fc(216)_IgG1_pI(-)_Isosteric_A_C220S/PVA_/S267K/L368D/K370S-IgG1_PVA_/S267K/S364K/E357Q Chain 1 - human_IL12p40_(GGGGS)5-human_IL12p35_(GGGGS)2_(single-chain)_Fc(216)_IgG1_pI(-
)_Isosteric_A_C220S/PVA_/S267K/L368D/K370S (SEQ ID NO: 722)
IWELKKDVYVVELDWYPDAPGEMVVLTCDTPEEDGITWTLDQSSEVLGSGKTLTIQVKEFGDAGQYTCHKGGEVLSHSL
LLLHKKEDGIWSTDILKDQKEPKNKTFLRCEAKNYSGRFTCWWLTTISTDLTFSVKSSRGSSDPQGVTCGAATLSAERV
RGDNKEYEYSVECQEDSACPAAEESLPIEVMVDAVHKLYENYTSSFFIRDIIKPDPPKNLQLKPLKNSRQVEVSWEYP
DTWSTPHSYFSLTFCVQVQGKSKREKKDRVFTDKTSATVICRKNASISVRAQDRYYSSSWSEWASVPCS/GGGGSGGGG
SGGGGSGGGGSGGGGS/RNLPVATPDPGMFPCLHHSQNLLRAVSNMLQKARQTLEFYPCTSEEIDHEDITKDKTSTVEA
CLPLELTKNESCLNSRETSFITNGSCLASRKTSFMMALCLSSIYEDLKMYQVEFKTMNAKLLMDPKRQIFLDQNMLAVI
DELMQALNFNSETVPQKSSLEEPDFYKTKIKLCILLHAFRIRAVTIDRVMSYLNAS/GGGGSGGGGS/EPKSSDKTHTC
PPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK Chain 2 - Numax_VH_IgG1_PVA_/S267K/S364K/E357Q (SEQ ID NO: 754)
QVTLRESGPALVKPTQTLTLTCTFSGFSLSTAGMSVGWIRQPPGKALEWLADIWWDDKKHYNPSLKDRLTISKDTSKNQ
VVLKVTNMDPADTATYYCARDMIFNFYFDVWGQGTTVTSS/ASTKGPSVFPLAPSSKSTSGGTAALGCLVKDYFPEPV
TVSWNSGALTSGVHTFPAVLQSSGLYSLSSVVTVPSSSLGTQTYICNVNHKPSNTKVDKKVEPKSCDKTHTCPPCPAPP
VAGPSVFLFPPKPKDTLMISRTPEVTCVVVDVKHEDPEVKFNWYVDGVEVHNAKTKPREEQYNSTYRVVSVLTVLHQDW
LNGKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK Chain 3 - Numax LC (SEQ ID NO: 755)
DIQMTQSPSTLSASVGDRVTITCSASSRVGYMHWYQQKPGKAPKLLIYDTSKLASGVPSRFSGSGSGTEFTLTISSLQP
DDFATYYCFQGSGYPFTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP31075 human_IL12p40_(GGGGS)5-human_IL12p35_(GGGGS)2_(single-chain)-Numax_Fc(216)_IgG1_pI(-
)_Isosteric_A_C220S/PVA_/S267K/L368D/K370S-IgG1_PVA_/S267K/S364K/E357Q Chain 1 - human_IL12p40_(GGGGS)5-human_IL12p35_(GGGGS)2_(single-chain)_Fc(216)_IgG1_pI(-
)_Isosteric_A_C220S/PVA_/S267K/L368D/K370S (SEQ ID NO: 722)
IWELKKDVYVVELDWYPDAPGEMVVLTCDTPEEDGITWTLDQSSEVLGSGKTLTIQVKEFGDAGQYTCHKGGEVLSHSL
LLLHKKEDGIWSTDILKDQKEPKNKTFLRCEAKNYSGRFTCWWLTTISTDLTFSVKSSRGSSDPQGVTCGAATLSAERV
RGDNKEYEYSVECQEDSACPAAEESLPIEVMVDAVHKLYENYTSSFFIRDIIKPDPPKNLQLKPLKNSRQVEVSWEYP
DTWSTPHSYFSLTFCVQVQGKSKREKKDRVFTDKTSATVICRKNASISVRAQDRYYSSSWSEWASVPCS/GGGGSGGGG
SGGGGSGGGGSGGGGS/RNLPVATPDPGMFPCLHHSQNLLRAVSNMLQKARQTLEFYPCTSEEIDHEDITKDKTSTVEA
CLPLELTKNESCLNSRETSFITNGSCLASRKTSFMMALCLSSIYEDLKMYQVEFKTMNAKLLMDPKRQIFLDQNMLAVI
DELMQALNFNSETVPQKSSLEEPDFYKTKIKLCILLHAFRIRAVTIDRVMSYLNAS/GGGGSGGGGS/EPKSSDKTHTC
PPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK Chain 2 - Numax_VH_IgG1_PVA_/S267K/S364K/E357Q (SEQ ID NO: 754)
QVTLRESGPALVKPTQTLTLTCTFSGFSLSTAGMSVGWIRQPPGKALEWLADIWWDDKKHYNPSLKDRLTISKDTSKNQ
VVLKVTNMDPADTATYYCARDMIFNFYFDVWGQGTTVTSS/ASTKGPSVFPLAPSSKSTSGGTAALGCLVKDYFPEPV
TVSWNSGALTSGVHTFPAVLQSSGLYSLSSVVTVPSSSLGTQTYICNVNHKPSNTKVDKKVEPKSCDKTHTCPPCPAPP
VAGPSVFLFPPKPKDTLMISRTPEVTCVVVDVKHEDPEVKFNWYVDGVEVHNAKTKPREEQYNSTYRVVSVLTVLHQDW
LNGKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK Chain 3 - Numax LC (SEQ ID NO: 755)
DIQMTQSPSTLSASVGDRVTITCSASSRVGYMHWYQQKPGKAPKLLIYDTSKLASGVPSRFSGSGSGTEFTLTISSLQP
DDFATYYCFQGSGYPFTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 82B

<u>>XENP31076 human_IL12p40_E32Q/D34N/E59K/K99E_(GGGGS)5-human_IL12p35_(GGGGS)2_(single-chain)-Numax_Fc(216)_IgG1_pI(-)_Isosteric_A_C220S/PVA_/S267K/L368D/K370S-IgG1_PVA_/S267K/S364K/E357Q</u>

Chain 1 - human_IL12p40_E32Q/D34N/E59K/K99E_(GGGGS)5-human_IL12p35_(GGGGS)2_(single-chain)_Fc(216)_IgG1_pI(-)_Isosteric_A_C220S/PVA_/S267K/L368D/K370S (SEQ ID NO: 733)

*IWELKKDVYVVELDWYPDAPGEMVVLTCDTPQENGITWTLDQSSEVLGSGKTLTIQVKKFGDAGQYTCHKGGEVLSHSL*
*LLLHKKEDGIWSTDILKDQEEPKNKTFLRCEAKNYSGRFTCWWLTTISTDLTFSVKSSRGSSDPQGVTCGAATLSAERV*
*RGDNKEYEYSVECQEDSACPAAEESLPIEVMVDAVHKLKYENYTSSFFIRDIIKPDPPKNLQLKPLKNSRQVEVSWEYP*
*DTWSTPHSYFSLTFCVQVQGKSKREKKDRVFTDKTSATVICRKNASISVRAQDRYYSSSWSEWASVPCS/<u>GGGGSGGGG</u>*
*<u>SGGGGSGGGGSGGGGS</u>/RNLPVATPDPGMFPCLHHSQNLLRAVSNMLQKARQTLEFYPCTSEEIDHEDITKDKTSTVEA*
*CLPLELTKNESCLNSRETSFITNGSCLASRKTSFMMALCLSSIYEDLKMYQVEFKTMNAKLLMDPKRQIFLDQNMLAVI*
*DELMQALNFNSETVPQKSSLEEPDFYKTKIKLCILLHAFRIRAVTIDRVMSYLNAS/<u>GGGGSGGGGS</u>/EPKSSDKTHTC*
PPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK

Chain 2 - Numax_VH_IgG1_PVA_/S267K/S364K/E357Q (SEQ ID NO: 754)
QVTLRESGPALVKPTQTLTLTCTFSGFSLS<u>TAGMS</u>VGWIRQPPGKALEWLAD<u>IWWDDKKHYNPSLKD</u>RLTISKDTSKNQ
VVLKVTNMDPADTATYYCARD<u>MIFNFYFDV</u>WGQGTTVTSS/ASTKGPSVFPLAPSSKSTSGGTAALGCLVKDYFPEPV
TVSWNSGALTSGVHTFPAVLQSSGLYSLSSVVTVPSSSLGTQTYICNVNHKPSNTKVDKKVEPKSCDKTHTCPPCPAPP
VAGPSVFLFPPKPKDTLMISRTPEVTCVVVDVKHEDPEVKFNWYVDGVEVHNAKTKPREEQYNSTYRVVSVLTVLHQDW
LNGKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK Chain 3 - Numax_LC (SEQ ID NO: 755)
DIQMTQSPSTLSASVGDRVTITC<u>SASSRVGYMH</u>WYQQKPGKAPKLLIY<u>DTSKLA</u>SGVPSRFSGSGSGTEFTLTISSLQP
DDFATYYC<u>FQGSGYPFT</u>FGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC <u>>XENP31107 human_IL12p40_E59K/K99E_(GGGGS)5-human_IL12p35_(GGGGS)2_(single-chain)-Numax_Fc(216)_IgG1_pI(-)_Isosteric_A_C220S/PVA_/S267K/L368D/K370S-IgG1_PVA_/S267K/S364K/E357Q</u>

Chain 1 - human_IL12p40_E59K/K99E_(GGGGS)5-human_IL12p35_(GGGGS)2_(single-chain)_Fc(216)_IgG1_pI(-)_Isosteric_A_C220S/PVA_/S267K/L368D/K370S (SEQ ID NO: 735)

*IWELKKDVYVVELDWYPDAPGEMVVLTCDTPEEDGITWTLDQSSEVLGSGKTLTIQVKKFGDAGQYTCHKGGEVLSHSL*
*LLLHKKEDGIWSTDILKDQEEPKNKTFLRCEAKNYSGRFTCWWLTTISTDLTFSVKSSRGSSDPQGVTCGAATLSAERV*
*RGDNKEYEYSVECQEDSACPAAEESLPIEVMVDAVHKLKYENYTSSFFIRDIIKPDPPKNLQLKPLKNSRQVEVSWEYP*
*DTWSTPHSYFSLTFCVQVQGKSKREKKDRVFTDKTSATVICRKNASISVRAQDRYYSSSWSEWASVPCS/<u>GGGGSGGGG</u>*
*<u>SGGGGSGGGGSGGGGS</u>/RNLPVATPDPGMFPCLHHSQNLLRAVSNMLQKARQTLEFYPCTSEEIDHEDITKDKTSTVEA*
*CLPLELTKNESCLNSRETSFITNGSCLASRKTSFMMALCLSSIYEDLKMYQVEFKTMNAKLLMDPKRQIFLDQNMLAVI*
*DELMQALNFNSETVPQKSSLEEPDFYKTKIKLCILLHAFRIRAVTIDRVMSYLNAS/<u>GGGGSGGGGS</u>/EPKSSDKTHTC*
PPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK

Chain 2 - Numax_VH_IgG1_PVA_/S267K/S364K/E357Q (SEQ ID NO: 754)
QVTLRESGPALVKPTQTLTLTCTFSGFSLS<u>TAGMS</u>VGWIRQPPGKALEWLAD<u>IWWDDKKHYNPSLKD</u>RLTISKDTSKNQ
VVLKVTNMDPADTATYYCARD<u>MIFNFYFDV</u>WGQGTTVTSS/ASTKGPSVFPLAPSSKSTSGGTAALGCLVKDYFPEPV
TVSWNSGALTSGVHTFPAVLQSSGLYSLSSVVTVPSSSLGTQTYICNVNHKPSNTKVDKKVEPKSCDKTHTCPPCPAPP
VAGPSVFLFPPKPKDTLMISRTPEVTCVVVDVKHEDPEVKFNWYVDGVEVHNAKTKPREEQYNSTYRVVSVLTVLHQDW
LNGKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK Chain 3 - Numax_LC (SEQ ID NO: 755)
DIQMTQSPSTLSASVGDRVTITC<u>SASSRVGYMH</u>WYQQKPGKAPKLLIY<u>DTSKLA</u>SGVPSRFSGSGSGTEFTLTISSLQP
DDFATYYC<u>FQGSGYPFT</u>FGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 82C

>XENP31138 human_IL12p40_(GGGGS)5-human_IL12p35_(GGGGS)2_(single-chain)-Numax_Fc(216)_IgG1_pI(-)_Isosteric_A_C220S/PVA_/S267K/L368D/K370S/M428L/N434S-IgG1_PVA_/S267K/S364K/E357Q/M428L/N434S Chain 1 - human_IL12p40_(GGGGS)5-human_IL12p35_(GGGGS)2_(single-chain)_Fc(216)_IgG1_pI(-)_Isosteric_A_C220S/PVA_/S267K/L368D/K370S/M428L/N434S (SEQ ID NO: 736)
*IWELKKDVYVVELDWYPDAPGEMVVLTCDTPEEDGITWTLDQSSEVLGSGKTLTIQVKEFGDAGQYTCHKGGEVLSHSL*
*LLLHKKEDGIWSTDILKDQKEPKNKTFLRCEAKNYSGRFTCWWLTTISTDLTFSVKSSRGSSDPQGVTCGAATLSAERV*
*RGDNKEYEYSVECQEDSACPAAEESLPIEVMVDAVHKLKYENYTSSFFIRDIIKPDPPKNLQLKPLKNSRQVEVSWEYP*
*DTWSTPHSYFSLTFCVQVQGKSKREKKDRVFTDKTSATVICRKNASISVRAQDRYYSSSWSEWASVPCS/*<u>GGGGSGGGG</u>
<u>SGGGGSGGGGSGGGGS</u>*/RNLPVATPDPGMFPCLHHSQNLLRAVSNMLQKARQTLEFYPCTSEEIDHEDITKDKTSTVEA*
*CLPLELTKNESCLNSRETSFITNGSCLASRKTSFMMALCLSSIYEDLKMYQVEFKTMNAKLLMDPKRQIFLDQNMLAVI*
*DELMQALNFNSETVPQKSSLEEPDFYKTKIKLCILLHAFRIRAVTIDRVMSYLNAS/*<u>GGGGSGGGGS</u>*/EPKSSDKTHTC*
*PPCPAPPVAGPSVFLFPPKPKDTLMISRTPEVTCVVVDVKHEDPEVKFNWYVDGVEVHNAKTKPREEEYNSTYRVVSVL*
*TVLHQDWLNGKEYKCKVSNKALPAPIEKTISKAKGQPREPQVYTLPPSREEMTKNQVSLTCDVSGFYPSDIAVEWESDG*
*QPENNYKTTPPVLDSDGSFFLYSKLTVDKSRWEQGDVFSCSVLHEALHSHYTQKSLSLSPGK*

Chain 2 - Numax_VH_IgG1_PVA_/S267K/S364K/E357Q/M428L/N434S (SEQ ID NO: 758)
QVTLRESGPALVKPTQTLTLTCTFSGFSLST<u>AGMSV</u>GWIRQPPGKALEWLA<u>DIWWDDKKHY</u>N<u>PSLK</u>DRLTISKDTSKNQ
VVLKVTNMDPADTATYYCARD<u>MIFNFYFDV</u>WGQGTTVTVSS/ASTKGPSVFPLAPSSKSTSGGTAALGCLVKDYFPEPV
TVSWNSGALTSGVHTFPAVLQSSGLYSLSSVVTVPSSSLGTQTYICNVNHKPSNTKVDKKVEPKSCDKTHTCPPCPAPP
VAGPSVFLFPPKPKDTLMISRTPEVTCVVVDVKHEDPEVKFNWYVDGVEVHNAKTKPREEQYNSTYRVVSVLTVLHQDW
LNGKEYKCKVSNKALPAPIEKTISKAKGQPREPQVYTLPPSREQMTKNQVKLTCLVKGFYPSDIAVEWESNGQPENNYK
TTPPPVLDSDGSFFLYSKLTVDKSRWQQGNVFSCSVLHEALHSHYTQKSLSLSPGK Chain 3 - Numax LC (SEQ ID NO: 755)
DIQMTQSPSTLSASVGDRVTITC<u>SASSPVGYMH</u>WYQQKPGKAPKLLIY<u>DTSKLAS</u>GVPSRFSGSGSGTEFTLTISSLQP
DDFATYYC<u>FQGSGYPFT</u>FGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP31139 human_IL12p40_E32Q/D34N/E59K/K99E_(GGGGS)5-human_IL12p35_(GGGGS)2_(single-chain)-Numax_Fc(216)_IgG1_pI(-)_Isosteric_A_C220S/PVA_/S267K/L368D/K370S/M428L/N434S-IgG1_PVA_/S267K/S364K/E357Q/M428L/N434S Chain 1 - human_IL12p40_E32Q/D34N/E59K/K99E_(GGGGS)5-human_IL12p35_(GGGGS)2_(single-chain)_Fc(216)_IgG1_pI(-)_Isosteric_A_C220S/PVA_/S267K/L368D/K370S/M428L/N434S (SEQ ID NO: 738)
*IWELKKDVYVVELDWYPDAPGEMVVLTCDTPQENGITWTLDQSSEVLGSGKTLTIQVKKFGDAGQYTCHKGGEVLSHSL*
*LLLHKKEDGIWSTDILKDQEEPKNKTFLRCEAKNYSGRFTCWWLTTISTDLTFSVKSSRGSSDPQGVTCGAATLSAERV*
*RGDNKEYEYSVECQEDSACPAAEESLPIEVMVDAVHKLKYENYTSSFFIRDIIKPDPPKNLQLKPLKNSRQVEVSWEYP*
*DTWSTPHSYFSLTFCVQVQGKSKREKKDRVFTDKTSATVICRKNASISVRAQDRYYSSSWSEWASVPCS/*<u>GGGGSGGGG</u>
<u>SGGGGSGGGGSGGGGS</u>*/RNLPVATPDPGMFPCLHHSQNLLRAVSNMLQKARQTLEFYPCTSEEIDHEDITKDKTSTVEA*
*CLPLELTKNESCLNSRETSFITNGSCLASRKTSFMMALCLSSIYEDLKMYQVEFKTMNAKLLMDPKRQIFLDQNMLAVI*
*DELMQALNFNSETVPQKSSLEEPDFYKTKIKLCILLHAFRIRAVTIDRVMSYLNAS/*<u>GGGGSGGGGS</u>*/EPKSSDKTHTC*
*PPCPAPPVAGPSVFLFPPKPKDTLMISRTPEVTCVVVDVKHEDPEVKFNWYVDGVEVHNAKTKPREEEYNSTYRVVSVL*
*TVLHQDWLNGKEYKCKVSNKALPAPIEKTISKAKGQPREPQVYTLPPSREEMTKNQVSLTCDVSGFYPSDIAVEWESDG*
*QPENNYKTTPPVLDSDGSFFLYSKLTVDKSRWEQGDVFSCSVLHEALHSHYTQKSLSLSPGK*

Chain 2 - Numax_VH_IgG1_PVA_/S267K/S364K/E357Q/M428L/N434S (SEQ ID NO: 758)
QVTLRESGPALVKPTQTLTLTCTFSGFSLST<u>AGMSV</u>GWIRQPPGKALEWLA<u>DIWWDDKKHY</u>N<u>PSLK</u>DRLTISKDTSKNQ
VVLKVTNMDPADTATYYCARD<u>MIFNFYFDV</u>WGQGTTVTVSS/ASTKGPSVFPLAPSSKSTSGGTAALGCLVKDYFPEPV
TVSWNSGALTSGVHTFPAVLQSSGLYSLSSVVTVPSSSLGTQTYICNVNHKPSNTKVDKKVEPKSCDKTHTCPPCPAPP
VAGPSVFLFPPKPKDTLMISRTPEVTCVVVDVKHEDPEVKFNWYVDGVEVHNAKTKPREEQYNSTYRVVSVLTVLHQDW
LNGKEYKCKVSNKALPAPIEKTISKAKGQPREPQVYTLPPSREQMTKNQVKLTCLVKGFYPSDIAVEWESNGQPENNYK
TTPPPVLDSDGSFFLYSKLTVDKSRWQQGNVFSCSVLHEALHSHYTQKSLSLSPGK Chain 3 - Numax LC (SEQ ID NO: 755)
DIQMTQSPSTLSASVGDRVTITC<u>SASSRVGYMH</u>WYQQKPGKAPKLLIY<u>DTSKLAS</u>GVPSRFSGSGSGTEFTLTISSLQP
DDFATYYC<u>FQGSGYPFT</u>FGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 82D

>XENP31141 human_IL12p40_E59K/K99E_(GGGGS)5-human_IL12p35_(GGGGS)2_(single-chain)-Numax_Fc(216)_IgG1_pl(-)_Isosteric_A_C220S/PVA_/S267K/L368D/K370S/M428L/N434S-IgG1_PVA_/S267K/S364K/E357Q/M428L/N434S

Chain 1 - human_IL12p40_E59K/K99E_(GGGGS)5-human_IL12p35_(GGGGS)2_(single-chain)_Fc(216)_IgG1_pl(-)_Isosteric_A_C220S/PVA_/S267K/L368D/K370S/M428L/N434S (SEQ ID NO: 739)

*IWELKKDVYVVELDWYPDAPGEMVVLTCDTPEEDGITWTLDQSSEVLGSGKTLTIQVKKFGDAGQYTCHKGGEVLSHSL
LLLHKKEDGIWSTDILKDQEEPKNKTFLRCEAKNYSGRFTCWWLTTISTDLTFSVKSSRGSSDPQGVTCGAATLSAERV
RGDNKEYEYSVECQEDSACPAAEESLPIEVMVDAVHKLKYENYTSSFFIRDIIKPDPPKNLQLKPLKNSRQVEVSWEYP
DTWSTPHSYFSLTFCVQVQGKSKREKKDRVFTDKTSATVICRKNASISVRAQDRYYSSSWSEWASVPCS*/<u>GGGGSGGGG
SGGGGSGGGGSGGGGS</u>/*RNLPVATPDPGMFPCLHHSQNLLRAVSNMLQKARQTLEFYPCTSEEIDHEDITKDKTSTVEA
CLPLELTKNESCLNSRETSFITNGSCLASRKTSFMMALCLSSIYEDLKMYQVEFKTMNAKLLMDPKRQIFLDQNMLAVI
DELMQALNFNSETVPQKSSLEEPDFYKTKIKLCILLHAFRIRAVTIDRVMSYLNAS*/<u>GGGGSGGGGS</u>/EPKSSDKTHTC
PPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVLHEALHSHYTQKSLSLSPGK

Chain 2 - Numax_VH_IgG1_PVA_/S267K/S364K/E357Q/M428L/N434S (SEQ ID NO: 758)

QVTLRESGPALVKPTQTLTLTCTFSGFSLST<u>AGMSVG</u>WIRQPPGKALEWLAD<u>IWWDDKKHYNPSLKD</u>RLTISKDTSKNQ
VVLKVTNMDPADTATYYCARD<u>MIFNFYFD</u>VWGQGTTVTVSS/ASTKGPSVFPLAPSSKSTSGGTAALGCLVKDYFPEPV
TVSWNSGALTSGVHTFPAVLQSSGLYSLSSVVTVPSSSLGTQTYICNVNHKPSNTKVDKKVEPKSCDKTHTCPPCPAPP
VAGPSVFLFPPKPKDTLMISRTPEVTCVVVDVKHEDPEVKFNWYVDGVEVHNAKTKPREEQYNSTYRVVSVLTVLHQDW
LNGKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVLHEALHSHYTQKSLSLSPGK

Chain 3 - Numax LC (SEQ ID NO: 755)

DIQMTQSPSTLSASVGDRVTITC<u>SASSRVGYMH</u>WYQQKPGKAPKLLIY<u>DTSKLA</u>SGVPSRFSGSGSGTEFTLTISSLQP
DDFATYYC<u>FQGSGYPFT</u>FGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP31457 human_IL12p40_E59K/K99Y_(GGGGS)5-human_IL12p35_(GGGGS)2_(single-chain)-Numax_Fc(216)_IgG1_pl(-)_Isosteric_A_C220S/PVA_/S267K/L368D/K370S-IgG1_PVA_/S267K/S364K/E357Q

Chain 1 - human_IL12p40_E59K/K99Y_(GGGGS)5-human_IL12p35_(GGGGS)2_(single-chain)_Fc(216)_IgG1_pl(-)_Isosteric_A_C220S/PVA_/S267K/L368D/K370S (SEQ ID NO: 740)

*IWELKKDVYVVELDWYPDAPGEMVVLTCDTPEEDGITWTLDQSSEVLGSGKTLTIQVKKFGDAGQYTCHKGGEVLSHSL
LLLHKKEDGIWSTDILKDQYEPKNKTFLRCEAKNYSGRFTCWWLTTISTDLTFSVKSSRGSSDPQGVTCGAATLSAERV
RGDNKEYEYSVECQEDSACPAAEESLPIEVMVDAVHKLKYENYTSSFFIRDIIKPDPPKNLQLKPLKNSRQVEVSWEYP
DTWSTPHSYFSLTFCVQVQGKSKREKKDRVFTDKTSATVICRKNASISVRAQDRYYSSSWSEWASVPCS*/<u>GGGGSGGGG
SGGGGSGGGGSGGGGS</u>/*RNLPVATPDPGMFPCLHHSQNLLRAVSNMLQKARQTLEFYPCTSEEIDHEDITKDKTSTVEA
CLPLELTKNESCLNSRETSFITNGSCLASRKTSFMMALCLSSIYEDLKMYQVEFKTMNAKLLMDPKRQIFLDQNMLAVI
DELMQALNFNSETVPQKSSLEEPDFYKTKIKLCILLHAFRIRAVTIDRVMSYLNAS*/<u>GGGGSGGGGS</u>/EPKSSDKTHTC
PPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK

Chain 2 - Numax_VH_IgG1_PVA_/S267K/S364K/E357Q (SEQ ID NO: 754)

QVTLRESGPALVKPTQTLTLTCTFSGFSLST<u>AGMSVG</u>WIRQPPGKALEWLAD<u>IWWDDKKHYNPSLKD</u>RLTISKDTSKNQ
VVLKVTNMDPADTATYYCARD<u>MIFNFYFD</u>VWGQGTTVTVSS/ASTKGPSVFPLAPSSKSTSGGTAALGCLVKDYFPEPV
TVSWNSGALTSGVHTFPAVLQSSGLYSLSSVVTVPSSSLGTQTYICNVNHKPSNTKVDKKVEPKSCDKTHTCPPCPAPP
VAGPSVFLFPPKPKDTLMISRTPEVTCVVVDVKHEDPEVKFNWYVDGVEVHNAKTKPREEQYNSTYRVVSVLTVLHQDW
LNGKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK

Chain 3 - Numax LC (SEQ ID NO: 755)

DIQMTQSPSTLSASVGDRVTITC<u>SASSRVGYMH</u>WYQQKPGKAPKLLIY<u>DTSKLA</u>SGVPSRFSGSGSGTEFTLTISSLQP
DDFATYYC<u>FQGSGYPFT</u>FGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 82E

>XENP31458 human_IL12p40_D18K/E59K/K99E_(GGGGS)5-human_IL12p35_(GGGGS)2_(single-chain)-Numax_Fc(216)_IgG1_pI(-)_Isosteric_A_C220S/PVA_/S267K/L368D/K370S-IgG1_PVA_/S267K/S364K/E357Q

Chain 1 - human_IL12p40_D18K/E59K/K99E_(GGGGS)5-human_IL12p35_(GGGGS)2_(single-chain)_Fc(216)_IgG1_pI(-)_Isosteric_A_C220S/PVA_/S267K/L368D/K370S (SEQ ID NO: 741)

*IWELKKDVYVVELDWYPKAPGEMVVLTCDTPEEDGITWTLDQSSEVLGSGKTLTIQVKKFGDAGQYTCHKGGEVLSHSL*
*LLLHKKEDGIWSTDILKDQEEPKNKTFLRCEAKNYSGRFTCWWLTTISTDLTFSVKSSRGSSDPQGVTCGAATLSAERV*
*RGDNKEYEYSVECQEDSACPAAEESLPIEVMVDAVHKLKYENYTSSFFIRDIIKPDPPKNLQLKPLKNSRQVEVSWEYP*
*DTWSTPHSYFSLTFCVQVQGKSKREKDRVFTDKTSATVICRKNASISVRAQDRYYSSSWSEWASVPCS*/GGGGSGGGG
SGGGGSGGGGSGGGGS/RNLPVATPDFGMFPCLHHSQNLLRAVSNMLQKARQTLEFYPCTSEEIDHEDITKDKTSTVEA
CLPLELTKNESCLNSRETSFITNGSCLASRKTSFMMALCLSSIYEDLKMYQVEFKTMNAKLLMDPKRQIFLDQNMLAVI
DELMQALNFNSETVPQKSSLEEPDFYKTKIKLCILLHAFRIRAVTIDRVMSYLNAS/GGGGSGGGGS/EPKSSDKTHTC
PPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK

Chain 2 - Numax_VH_IgG1_PVA_/S267K/S364K/E357Q (SEQ ID NO: 754)
QVTLRESGPALVKPTQTLTLTCTFSGFSLSTAGMSVGWIRQPPGKALEWLADIWWDDKKHYNPSLKDRLTISKDTSKNQ
VVLKVTNMDPADTATYYCARDMIFNFYFDVWGQGTTVTVSS/ASTKGPSVFPLAPSSKSTSGGTAALGCLVKDYFPEPV
TVSWNSGALTSGVHTFPAVLQSSGLYSLSSVVTVPSSSLGTQTYICNVNHKPSNTKVDKKVEPKSCDKTHTCPPCPAPP
VAGPSVFLFPPKPKDTLMISRTPEVTCVVVDVKHEDPEVKFNWYVDGVEVHNAKTKPREEQYNSTYRVVSVLTVLHQDW
LNGKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK

Chain 3 - Numax LC (SEQ ID NO: 755)
DIQMTQSPSTLSASVGDRVTITCSASSRVGYMHWYQQKPGKAPKLLIYDTSKLASGVPSRFSGSGSGTEFTLTISSLQP
DDFATYYCFQGSGYPFTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP31459 human_IL12p40_E59K/K99E/K264E_(GGGGS)5-human_IL12p35_(GGGGS)2_(single-chain)-Numax_Fc(216)_IgG1_pI(-)_Isosteric_A_C220S/PVA_/S267K/L368D/K370S-IgG1_PVA_/S267K/S364K/E357Q

Chain 1 - human_IL12p40_E59K/K99E/K264E_(GGGGS)5-human_IL12p35_(GGGGS)2_(single-chain)_Fc(216)_IgG1_pI(-)_Isosteric_A_C220S/PVA_/S267K/L368D/K370S (SEQ ID NO: 742)

*IWELKKDVYVVELDWYPDAPGEMVVLTCDTPEEDGITWTLDQSSEVLGSGKTLTIQVKKFGDAGQYTCHKGGEVLSHSL*
*LLLHKKEDGIWSTDILKDQEEPKNKTFLRCEAKNYSGRFTCWWLTTISTDLTFSVKSSRGSSDPQGVTCGAATLSAERV*
*RGDNKEYEYSVECQEDSACPAAEESLPIEVMVDAVHKLKYENYTSSFFIRDIIKPDPPKNLQLKPLKNSRQVEVSWEYP*
*DTWSTPHSYFSLTFCVQVQGKSKREKEDRVFTDKTSATVICRKNASISVRAQDRYYSSSWSEWASVPCS*/GGGGSGGGG
SGGGGSGGGGSGGGGS/RNLPVATPDFGMFPCLHHSQNLLRAVSNMLQKARQTLEFYPCTSEEIDHEDITKDKTSTVEA
CLPLELTKNESCLNSRETSFITNGSCLASRKTSFMMALCLSSIYEDLKMYQVEFKTMNAKLLMDPKRQIFLDQNMLAVI
DELMQALNFNSETVPQKSSLEEPDFYKTKIKLCILLHAFRIRAVTIDRVMSYLNAS/GGGGSGGGGS/EPKSSDKTHTC
PPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK

Chain 2 - Numax_VH_IgG1_PVA_/S267K/S364K/E357Q (SEQ ID NO: 754)
QVTLRESGPALVKPTQTLTLTCTFSGFSLSTAGMSVGWIRQPPGKALEWLADIWWDDKKHYNPSLKDRLTISKDTSKNQ
VVLKVTNMDPADTATYYCARDMIFNFYFDVWGQGTTVTVSS/ASTKGPSVFPLAPSSKSTSGGTAALGCLVKDYFPEPV
TVSWNSGALTSGVHTFPAVLQSSGLYSLSSVVTVPSSSLGTQTYICNVNHKPSNTKVDKKVEPKSCDKTHTCPPCPAPP
VAGPSVFLFPPKPKDTLMISRTPEVTCVVVDVKHEDPEVKFNWYVDGVEVHNAKTKPREEQYNSTYRVVSVLTVLHQDW
LNGKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK

Chain 3 - Numax LC (SEQ ID NO: 755)
DIQMTQSPSTLSASVGDRVTITCSASSRVGYMHWYQQKPGKAPKLLIYDTSKLASGVPSRFSGSGSGTEFTLTISSLQP
DDFATYYCFQGSGYPFTFGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 82F

>XENP31587 human_IL12p40_E59K/K99E/K264E_(GGGGS)5-human_IL12p35_(GGGGS)2_(single-chain)-Numax_Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S

Chain 1 - human_IL12p40_E59K/K99E/K264E_(GGGGS)5-human_IL12p35_(GGGGS)2_(single-chain)_Fc(216)_IgG1_pI(-)_Isosteric_A_C220S/PVA_/S267K/L368D/K370S/M428L/N434S (SEQ ID NO: 743)

*IWELKKDVYVVELDWYPDAPGEMVVLTCDTPEEDGITWTLDQSSEVLGSGKTLTIQVKKFGDAGQYTCHKGGEVLSHSL
LLLHKKEDGIWSTDILKDQEEPKNKTFLRCEAKNYSGRFTCWWLTTISTDLTFSVKSSRGSSDPQGVTCGAATLSAERV
RGDNKEYEYSVECQEDSACPAAEESLPIEVMVDAVHKLKYENYTSSFFIRDIIKPDPPKNLQLKPLKNSRQVEVSWEYP
DTWSTPHSYFSLTFCVQVQGKSKREKEDRVFTDKTSATVICRKNASISVRAQDRYYSSSWSEWASVPCS/GGGGSGGGG
SGGGGSGGGGSGGGGS/RNLPVATPDPGMFPCLHHSQNLLRAVSNMLQKARQTLEFYPCTSEEIDHEDITKDKTSTVEA
CLPLELTKNESCLNSRETSFITNGSCLASRKTSFMMALCLSSIYEDLKMYQVEFKTMNAKLLMDPKRQIFLDQNMLAVI
DELMQALNFNSETVPQKSSLEEPDFYKTKIKLCILLHAFRIRAVTIDRVMSYLNAS/GGGGSGGGGS/EPKSSDKTHTC
PPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWQEGDVFSCSVLHEALHSHYTQKSLSLSPGK*

Chain 2 - Numax_VH_IgG1_C220S/PVA_/S267K/S364K/E357Q/M428L/N434S (SEQ ID NO: 759)

QVTLRESGPALVKPTQTLTLTCTFSGFSLST*AGMSVG*WIRQPPGKALEWLA*DIWWDDKKHYNPSLKDR*LTISKDTSKNQ
VVLKVTNMDPADTATYYCARD*MIFNFYFDV*WGQGTTVTVSS/ASTKGPSVFPLAPSSKSTSGGTAALGCLVKDYFPEPV
TVSWNSGALTSGVHTFPAVLQSSGLYSLSSVVTVPSSSLGTQTYICNVNHKPSNTKVDKKVEPKSCDKTHTCPPCPAPP
VAGPSVFLFPPKPKDTLMISRTPEVTCVVVDVKHEDPEVKFNWYVDGVEVHNAKTKPREEQYNSTYRVVSVLTVLHQDW
LNGKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVLHEALHSHYTQKSLSLSPGK

Chain 3 - Numax LC (SEQ ID NO: 755)

DIQMTQSPSTLSASVGDRVTITC*SASSRVGYMH*WYQQKPGKAPKLLIY*DTSKLA*SGVPSRFSGSGSGTEFTLTISSLQP
DDFATYYC*FQGSGYPFT*FGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

>XENP32196 human_IL12p40_D18K/E59K/K99E/K264E_(GGGGS)5-human_IL12p35_(GGGGS)2_(single-chain)-Numax_Fc(216)_IgG1_pI(-)_Isosteric_A_C220S/PVA_/S267K/L368D/K370S-IgG1_PVA_/S267K/S364K/E357Q

Chain 1 - human_IL12p40_D18K/E59K/K99E/K264E_(GGGGS)5-human_IL12p35_(GGGGS)2_(single-chain)_Fc(216)_IgG1_pI(-)_Isosteric_A_C220S/PVA_/S267K/L368D/K370S (SEQ ID NO: 746)

*IWELKKDVYVVELDWYPKAPGEMVVLTCDTPEEDGITWTLDQSSEVLGSGKTLTIQVKKFGDAGQYTCHKGGEVLSHSL
LLLHKKEDGIWSTDILKDQEEPKNKTFLRCEAKNYSGRFTCWWLTTISTDLTFSVKSSRGSSDPQGVTCGAATLSAERV
RGDNKEYEYSVECQEDSACPAAEESLPIEVMVDAVHKLKYENYTSSFFIRDIIKPDPPKNLQLKPLKNSRQVEVSWEYP
DTWSTPHSYFSLTFCVQVQGKSKREKEDRVFTDKTSATVICRKNASISVRAQDRYYSSSWSEWASVPCS/GGGGSGGGG
SGGGGSGGGGSGGGGS/RNLPVATPDPGMFPCLHHSQNLLRAVSNMLQKARQTLEFYPCTSEEIDHEDITKDKTSTVEA
CLPLELTKNESCLNSRETSFITNGSCLASRKTSFMMALCLSSIYEDLKMYQVEFKTMNAKLLMDPKRQIFLDQNMLAVI
DELMQALNFNSETVPQKSSLEEPDFYKTKIKLCILLHAFRIRAVTIDRVMSYLNAS/GGGGSGGGGS/EPKSSDKTHTC
PPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWQEGDVFSCSVMHEALHNHYTQKSLSLSPGK*

Chain 2 - Numax_VH_IgG1_PVA_/S267K/S364K/E357Q (SEQ ID NO: 754)

QVTLRESGPALVKPTQTLTLTCTFSGFSLST*AGMSVG*WIRQPPGKALEWLA*DIWWDDKKHYNPSLKDR*LTISKDTSKNQ
VVLKVTNMDPADTATYYCARD*MIFNFYFDV*WGQGTTVTVSS/ASTKGPSVFPLAPSSKSTSGGTAALGCLVKDYFPEPV
TVSWNSGALTSGVHTFPAVLQSSGLYSLSSVVTVPSSSLGTQTYICNVNHKPSNTKVDKKVEPKSCDKTHTCPPCPAPP
VAGPSVFLFPPKPKDTLMISRTPEVTCVVVDVKHEDPEVKFNWYVDGVEVHNAKTKPREEQYNSTYRVVSVLTVLHQDW
LNGKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK

Chain 3 - Numax LC (SEQ ID NO: 755)

DIQMTQSPSTLSASVGDRVTITC*SASSRVGYMH*WYQQKPGKAPKLLIY*DTSKLA*SGVPSRFSGSGSGTEFTLTISSLQP
DDFATYYC*FQGSGYPFT*FGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 82G

>XENP32197 human_IL12p40_D18K/E59K/K99E/C252S_(GGGGS)5-human_IL12p35_(GGGGS)2_(single-chain)-Numax_Fc(216)_IgG1_pI(-)_Isosteric_A_C220S/PVA_/S267K/L368D/K370S-IgG1_PVA_/S267K/S364K/E357Q Chain 1 - human_IL12p40_D18K/E59K/K99E/C252S_(GGGGS)5-human_IL12p35_(GGGGS)2_(single-chain)_Fc(216)_IgG1_pI(-)_Isosteric_A_C220S/PVA_/S267K/L368D/K370S (SEQ ID NO: 747)
*IWELKKDVYVVELDWYPKAPGEMVVLTCDTPEEDGITWTLDQSSEVLGSGKTLTIQVKKFGDAGQYTCHKGGEVLSHSL*
*LLLHKKEDGIWSTDILKDQEEPKNKTFLRCEAKNYSGRFTCWWLTTISTDLTFSVKSSRGSSDPQGVTCGAATLSAERV*
*RGDNKEYEYSVECQEDSACPAAEESLPIEVMVDAVHKLKYENYTSSFFIRDIIKPDPPKNLQLKPLKNSRQVEVSWEYP*
*DTWSTPHSYFSLTFSVQVQGKSKREKKDRVFTDKTSATVICRKNASISVRAQDRYYSSSWSEWASVPCS/<u>GGGGSGGGG</u>*
<u>*SGGGGSGGGGSGGGGS*</u>*/RNLPVATPDPGMFPCLHHSQNLLRAVSNMLQKARQTLEFYPCTSEEIDHEDITKDKTSTVEA*
*CLPLELTKNESCLNSRETSFITNGSCLASRKTSFMMALCLSSIYEDLKMYQVEFKTMNAKLLMDPKRQIFLDQNMLAVI*
*DELMQALNFNSETVPQKSSLEEPDFYKTKIKLCILLHAFRIRAVTIDRVMSYLNAS/*<u>*GGGGSGGGGS*</u>*/EPKSSDKTHTC*
PPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK Chain 2 - Numax_VH_IgG1_PVA_/S267K/S364K/E357Q (SEQ ID NO: 754)
QVTLRESGPALVKPTQTLTLTCTFSGFSLST<u>AGMSV</u>GWIRQPPGKALEWLAD<u>IWWDDKKHYNPSLKDR</u>LTISKDTSKNQ
VVLKVTNMDPADTATYYCARD<u>MIFNFYFDV</u>WGQGTTVTVSS/ASTKGPSVFPLAPSSKSTSGGTAALGCLVKDYFPEPV
TVSWNSGALTSGVHTFPAVLQSSGLYSLSSVVTVPSSSLGTQTYICNVNHKPSNTKVDKKVEPKSCDKTHTCPPCPAPP
VAGPSVFLFPPKPKDTLMISRTPEVTCVVVDVKHEDPEVKFNWYVDGVEVHNAKTKPREEQYNSTYRVVSVLTVLHQDW
LNGKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK Chain 3 - Numax LC (SEQ ID NO: 755)
DIQMTQSPSTLSASVGDRVTITC<u>SASSRVGYMH</u>WYQQKPGKAPKLLIY<u>DTSKLAS</u>GVPSRFSGSGSGTEFTLTISSLQP
DDFATYYC<u>FQGSGYPFT</u>FGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC >XENP32198 human_IL12p40_D18K/E59K/K99E/C252S/K264E_(GGGGS)5-human_IL12p35_(GGGGS)2_(single-chain)-Numax_Fc(216)_IgG1_pI(-)_Isosteric_A_C220S/PVA_/S267K/L368D/K370S-IgG1_PVA_/S267K/S364K/E357Q Chain 1 - human_IL12p40_D18K/E59K/K99E/C252S/K264E_(GGGGS)5-human_IL12p35_(GGGGS)2_(single-chain)_Fc(216)_IgG1_pI(-)_Isosteric_A_C220S/PVA_/S267K/L368D/K370S (SEQ ID NO: 749)
*IWELKKDVYVVELDWYPKAPGEMVVLTCDTPEEDGITWTLDQSSEVLGSGKTLTIQVKKFGDAGQYTCHKGGEVLSHSL*
*LLLHKKEDGIWSTDILKDQEEPKNKTFLRCEAKNYSGRFTCWWLTTISTDLTFSVKSSRGSSDPQGVTCGAATLSAERV*
*RGDNKEYEYSVECQEDSACPAAEESLPIEVMVDAVHKLKYENYTSSFFIRDIIKPDPPKNLQLKPLKNSRQVEVSWEYP*
*DTWSTPHSYFSLTFSVQVQGKSKREKEDRVFTDKTSATVICRKNASISVRAQDRYYSSSWSEWASVPCS/<u>GGGGSGGGG</u>*
<u>*SGGGGSGGGGSGGGGS*</u>*/RNLPVATPDPGMFPCLHHSQNLLRAVSNMLQKARQTLEFYPCTSEEIDHEDITKDKTSTVEA*
*CLPLELTKNESCLNSRETSFITNGSCLASRKTSFMMALCLSSIYEDLKMYQVEFKTMNAKLLMDPKRQIFLDQNMLAVI*
*DELMQALNFNSETVPQKSSLEEPDFYKTKIKLCILLHAFRIRAVTIDRVMSYLNAS/*<u>*GGGGSGGGGS*</u>*/EPKSSDKTHTC*
PPCPAPPVAGPSVFLFPPKPKDTLMISRTPEVTCVVVDVKHEDPEVKFNWYVDGVEVHNAKTKPREEEYNSTYRVVSVL
TVLHQDWLNGKEYKCKVSNKALPAPIEKTISKAKGQPREPQVYTLPPSREEMTKNQVSLTCDVSGFYPSDIAVEWESDG
QPENNYKTTPPVLDSDGSFFLYSKLTVDKSRWEQGDVFSCSVMHEALHNHYTQKSLSLSPGK Chain 2 - Numax_VH_IgG1_PVA_/S267K/S364K/E357Q (SEQ ID NO: 754)
QVTLRESGPALVKPTQTLTLTCTFSGFSLST<u>AGMSV</u>GWIRQPPGKALEWLAD<u>IWWDDKKHYNPSLKDR</u>LTISKDTSKNQ
VVLKVTNMDPADTATYYCARD<u>MIFNFYFDV</u>WGQGTTVTVSS/ASTKGPSVFPLAPSSKSTSGGTAALGCLVKDYFPEPV
TVSWNSGALTSGVHTFPAVLQSSGLYSLSSVVTVPSSSLGTQTYICNVNHKPSNTKVDKKVEPKSCDKTHTCPPCPAPP
VAGPSVFLFPPKPKDTLMISRTPEVTCVVVDVKHEDPEVKFNWYVDGVEVHNAKTKPREEQYNSTYRVVSVLTVLHQDW
LNGKEYKCKVSNKALPAPIEKTISKAKGQPREPQVYTLPPSREQMTKNQVKLTCLVKGFYPSDIAVEWESNGQPENNYK
TTPPVLDSDGSFFLYSKLTVDKSRWQQGNVFSCSVMHEALHNHYTQKSLSLSPGK Chain 3 - Numax LC (SEQ ID NO: 755)
DIQMTQSPSTLSASVGDRVTITC<u>SASSRVGYMH</u>WYQQKPGKAPKLLIY<u>DTSKLAS</u>GVPSRFSGSGSGTEFTLTISSLQP
DDFATYYC<u>FQGSGYPFT</u>FGGGTKVEIK/RTVAAPSVFIFPPSDEQLKSGTASVVCLLNNFYPREAKVQWKVDNALQSGN
SQESVTEQDSKDSTYSLSSTLTLSKADYEKHKVYACEVTHQGLSSPVTKSFNRGEC

Figure 82H

>XENP32199 human_IL12p40_E59K/K99E/C252S/K264E_(GGGGS)5-human_IL12p35_(GGGGS)2_(single-chain)-Numax_Fc(216)_IgG1_pI(-)_Isosteric_A_C220S/PVA_/S267K/L368D/K370S-IgG1_PVA_/S267K/S364K/E357Q Chain 1 - human_IL12p40_E59K/K99E/C252S/K264E_(GGGGS)5-human_IL12p35_(GGGGS)2_(single-chain)_Fc(216)_IgG1_pI(-)_Isosteric_A_C220S/PVA_/S267K/L368D/K370S
IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 750)

Chain 2 - Numax_VH_IgG1_PVA_/S267K/S364K/E357Q
QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK
(SEQ ID NO: 754)

Chain 3 - Numax LC
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

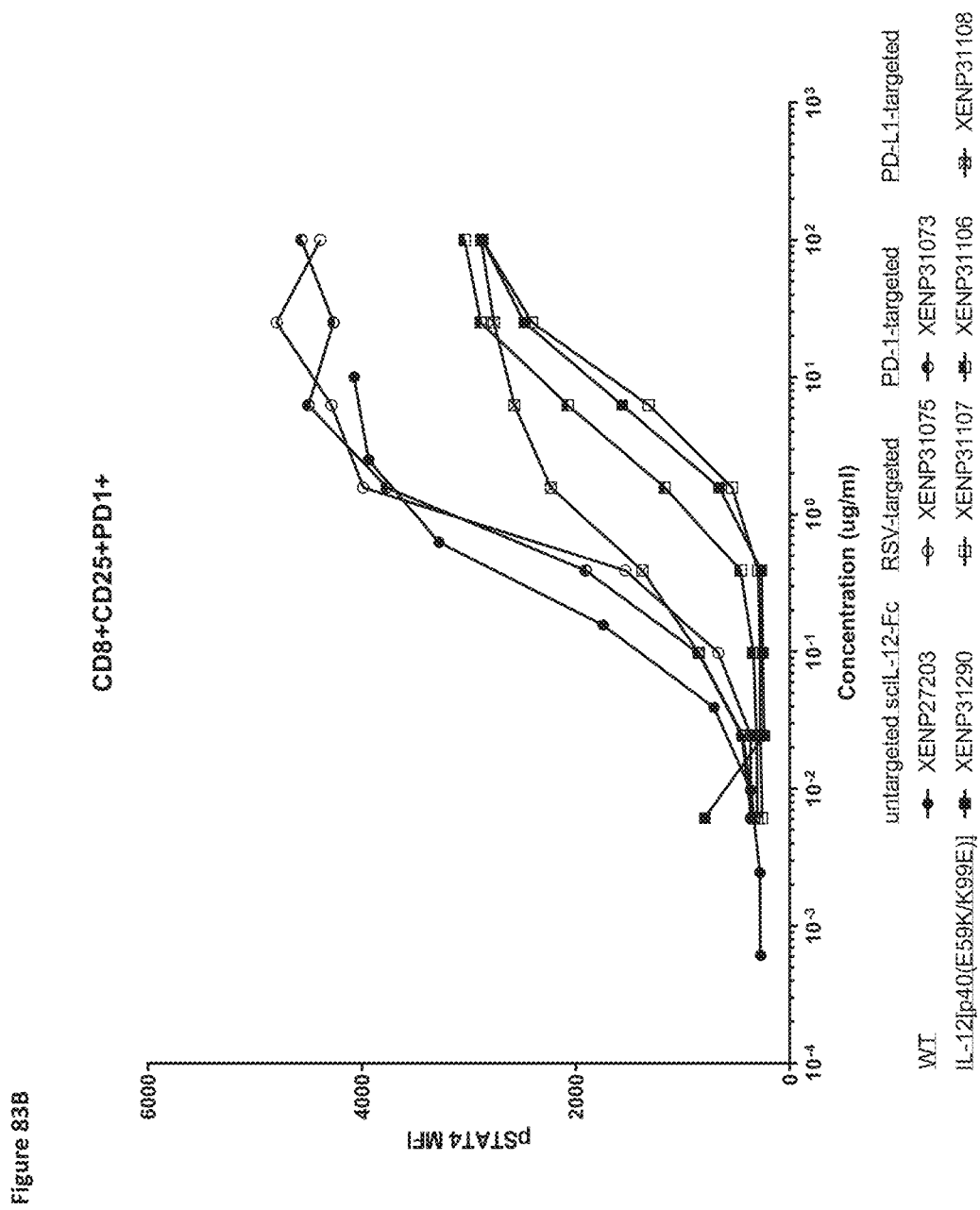

Figure 89A

IL12p40 Variants - Affinity Variants + C252S

<u>IL12p40(E59K/C252S)</u>
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS    (SEQ ID NO: 763)

Figure 89B

IL12p40 Variants - Affinity Variants + N200Q

<u>IL12p40(E59K/N200Q)</u>
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS    (SEQ ID NO: 764)

<u>IL12p40(E59K/K99Y/N200Q)</u>
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQYEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS    (SEQ ID NO: 765)

<u>IL12p40(E59K/K99E/N200Q)</u>
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS    (SEQ ID NO: 766)

<u>IL12p40(D18K/E59K/K99E/N200Q)</u>
IEWLKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS    (SEQ ID NO: 767)

<u>IL12p40(E59K/K99E/N200Q/K264E)</u>
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREEDRVFTDKTSATVICRKNASISVRAQDRYYSSSWSEW
ASVPCS    (SEQ ID NO: 768)

<u>IL12p40(D18K/E59K/K99E/N200Q/K264E)</u>
IEWLKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREEDRVFTDKTSATVICRKNASISVRAQDRYYSSSWSEW
ASVPCS    (SEQ ID NO: 769)

Figure 89C

IL12p40 Variants - Affinity Variants + C252S + N200Q

<u>IL12p40(E59K/N200Q/C252S)</u>
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS (SEQ ID NO: 770)

<u>IL12p40(E59K/K99Y/N200Q/C252S)</u>
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQYEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS (SEQ ID NO: 771)

<u>IL12p40(E59K/K99E/N200Q/C252S)</u>
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS (SEQ ID NO: 772)

<u>IL12p40(D18K/E59K/K99E/N200Q/C252S)</u>
IEWLKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS (SEQ ID NO: 773)

<u>IL12p40(D18K/E59K/K99E/N200Q/C252S/K264E)</u>
IEWLKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREEDRVFTDKTSATVICRKNASISVRAQDRYYSSSWSEW
ASVPCS (SEQ ID NO: 774)

Figure 90

Untargeted Non-Xtend - Affinity Variants + C252S

>XENCXXX human_IL12p40(E59K/C252S)_(GGGGS)2-human_IL12p35_(GGGGS)2-Fc(216)_IgG1_pI(-)_Isosteric_A_C220S/PVA_/S267K/L368D/K370S_Fc(216)_IgG1_C220S/PVA_/S267K/S364K/E357Q Chain 1 - human_IL12p40(E59K/C252S)_(GGGGS)2_Fc(216)_IgG1_pI(-)_Isosteric_A_C220S/PVA_/S267K/L368D/K370S IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK (SEQ ID NO: 775)

Chain 2 - IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS*/GGGGSGGGGS/*EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK* (SEQ ID NO: 776)

Figure 91A

Untargeted Non-Xtend - Affinity Variants + N200Q

<u>>XENCXXX human_IL12p40(E59K/N200Q)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q</u>

**Chain 1 - human_IL12p40(E59K/N200Q)_(GGGGS)2_Fc(216)_IgG1_pI(-
)_Isosteric_A_C220S/PVA_/S267K/L368D/K370S**
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSREKKDRVFTDKTSATVICRKNASISVRAQDRYYSSSWSEW
ASVPCS/<u>GGGGSGGGGS</u>/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK    (SEQ ID NO: 777)

Chain 2 - IL12p35_(GGGGS)2_Fc(216)_IgG1_C220S/PVA_/S267K/S364K/E357Q
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/<u>GGGGSGGGGS</u>/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK    (SEQ ID NO:
776)*

<u>>XENCXXX human_IL12p40(E59K/K99Y/N200Q)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q</u>

**Chain 1 - human_IL12p40(E59K/K99Y/N200Q)_(GGGGS)2_Fc(216)_IgG1_pI(-
)_Isosteric_A_C220S/PVA_/S267K/L368D/K370S**
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQYEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSREKKDRVFTDKTSATVICRKNASISVRAQDRYYSSSWSEW
ASVPCS/<u>GGGGSGGGGS</u>/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK    (SEQ ID NO: 778)

Chain 2 - IL12p35_(GGGGS)2_Fc(216)_IgG1_C220S/PVA_/S267K/S364K/E357Q
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/<u>GGGGSGGGGS</u>/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK    (SEQ ID NO:
776)*

Figure 91B

>XENCXXX human_IL12p40(E59K/K99E/N200Q)_(GGGGS)2-human_IL12p35_(GGGGS)2-Fc(216)_IgG1_pl(-)_Isosteric_A_C220S/PVA_/S267K/L368D/K370S_Fc(216)_IgG1_C220S/PVA_/S267K/S364K/E357Q

Chain 1 - human_IL12p40(E59K/K99E/N200Q)_(GGGGS)2_Fc(216)_IgG1_pl(-)_Isosteric_A_C220S/PVA_/S267K/L368D/K370S

IEWLKKDVYVVELDWYPDAPGEMVVLTCDTPEEDGITWTLDQSSEVLGSGKTLTIQVK<u>K</u>FGDAGQYTCHKGGEVL
SHSLLLLHKKEDGIWSTDILKDQ<u>E</u>EPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYE<u>Q</u>YTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/<u>GGGGSGGGGS</u>/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK (SEQ ID NO: 779)

Chain 2 - IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL*
*NSRETSFITNGSCLASRKTSFMMALCLSSIYEDLKMYQVEFKTMNAKLLMDPKRQIFLDQNMLAVIDELMQALNF*
*NSETVPQKSSLEEPDFYKTKIKLCILLHAFRIRAVTIDRVMSYLNAS*/<u>GGGGSGGGGS</u>/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREMTKNQVKLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO: 776)

>XENP33669 human_IL12p40(D18K/E59K/K99E/N200Q)_(GGGGS)2-human_IL12p35_(GGGGS)2-Fc(216)_IgG1_pl(-)_Isosteric_A_C220S/PVA_/S267K/L368D/K370S_Fc(216)_IgG1_C220S/PVA_/S267K/S364K/E357Q

Chain 1 - human_IL12p40(D18K/E59K/K99E/N200Q)_(GGGGS)2_Fc(216)_IgG1_pl(-)_Isosteric_A_C220S/PVA_/S267K/L368D/K370S

IWELKKDVYVVELDWYP<u>K</u>APGEMVVLTCDTPEEDGITWTLDQSSEVLGSGKTLTIQVK<u>K</u>FGDAGQYTCHKGGEVL
SHSLLLLHKKEDGIWSTDILKDQ<u>E</u>EPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYE<u>Q</u>YTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/<u>GGGGSGGGGS</u>/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK (SEQ ID NO: 780)

Chain 2 - human_IL12p35_(GGGGS)2_Fc(216)_IgG1_C220S/PVA_/S267K/S364K/E357Q

*RNLPVATPDPGMFPCLHHSQNLLRAVSNMLQKARQTLEFYPCTSEEIDHEDITKDKTSTVEACLPLELTKNESCL*
*NSRETSFITNGSCLASRKTSFMMALCLSSIYEDLKMYQVEFKTMNAKLLMDPKRQIFLDQNMLAVIDELMQALNF*
*NSETVPQKSSLEEPDFYKTKIKLCILLHAFRIRAVTIDRVMSYLNAS*/<u>GGGGSGGGGS</u>/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREMTKNQVKLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO: 781)

Figure 91C

>XENP33671 human_IL12p40(E59K/K99E/N200Q/K264E)_(GGGGS)2-human_IL12p35_(GGGGS)2-
Fc(216)_IgG1_pI(-
)_Isosteric_A_C220S/PVA_/S267K/L368D/K370S_Fc(216)_IgG1_C220S/PVA_/S267K/S364K/E357Q Chain 1 - human_IL12p40(E59K/K99E/N200Q/K264E)_(GGGGS)2_Fc(216)_IgG1_pI(-
)_Isosteric_A_C220S/PVA_/S267K/L368D/K370S
IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKEDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK   (SEQ ID NO: 782)

Chain 2 - human_IL12p35_(GGGGS)2_Fc(216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK   (SEQ ID NO: 781)

>XENP33672 human_IL12p40(D18K/E59K/K99E/N200Q/K264E)_(GGGGS)2-human_IL12p35_(GGGGS)2-
Fc(216)_IgG1_pI(-
)_Isosteric_A_C220S/PVA_/S267K/L368D/K370S_Fc(216)_IgG1_C220S/PVA_/S267K/S364K/E357Q Chain 1 - human_IL12p40(D18K/E59K/K99E/N200Q/K264E)_(GGGGS)2_Fc(216)_IgG1_pI(-
)_Isosteric_A_C220S/PVA_/S267K/L368D/K370S
IWELKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKEDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK   (SEQ ID NO: 783)

Chain 2 - human_IL12p35_(GGGGS)2_Fc(216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK   (SEQ ID NO: 781)

Figure 92A

Untargeted Non-Xtend - Affinity Variants + C252S + N200Q

>XENCXXX human_IL12p40(E59K/N200Q/C252S)_(GGGGS)2-human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q Chain 1 - human_IL12p40(E59K/N200Q/C252S)_(GGGGS)2_Fc(216)_IgG1_pI(-
)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK   (SEQ ID NO: 784)

Chain 2 - IL12p35_(GGGGS)2_Fc(216)_IgG1_C220S/PVA_/S267K/S364K/E357Q
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS*/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK   (SEQ ID NO: 776)

>XENCXXX human_IL12p40(E59K/K99Y/N200Q/C252S)_(GGGGS)2-human_IL12p35_(GGGGS)2-
Fc(216)_IgG1_pI(-
)_Isosteric_A_C220S/PVA_/S267K/L368D/K370S_Fc(216)_IgG1_C220S/PVA_/S267K/S364K/E357Q Chain 1 - human_IL12p40(E59K/K99Y/N200Q/C252S)_(GGGGS)2_Fc(216)_IgG1_pI(-
)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQYEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK   (SEQ ID NO: 785)

Chain 2 - IL12p35_(GGGGS)2_Fc(216)_IgG1_C220S/PVA_/S267K/S364K/E357Q
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS*/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK   (SEQ ID NO: 776)

Figure 92B

>XENCXXX human_IL12p40(E59K/K99E/N200Q/C252S)_(GGGGS)2-human_IL12p35_(GGGGS)2-
Fc(216)_IgG1_pI(-
)_Isosteric_A_C220S/PVA_/S267K/L368D/K370S_Fc(216)_IgG1_C220S/PVA_/S267K/S364K/E357Q Chain 1 - human_IL12p40(E59K/K99E/N200Q/C252S)_(GGGGS)2_Fc(216)_IgG1_pI(-
)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK (SEQ ID NO: 786)

Chain 2 - IL12p35_(GGGGS)2_Fc(216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO: 776)

>XENP33670 human_IL12p40(D18K/E59K/K99E/N200Q/C252S)_(GGGGS)2-human_IL12p35_(GGGGS)2-
Fc(216)_IgG1_pI(-
)_Isosteric_A_C220S/PVA_/S267K/L368D/K370S_Fc(216)_IgG1_C220S/PVA_/S267K/S364K/E357Q Chain 1 - human_IL12p40(D18K/E59K/K99E/N200Q/C252S)_(GGGGS)2_Fc(216)_IgG1_pI(-
)_Isosteric_A_C220S/PVA_/S267K/L368D/K370S
IWELKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK (SEQ ID NO: 787)

Chain 2 - human_IL12p35_(GGGGS)2_Fc(216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO: 781)

Figure 92C

\>XENP33673 human_IL12p40(D18K/E59K/K99E/N200Q/C252S/K264E)_(GGGGS)2-
human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q

**Chain 1 - human_IL12p40(D18K/E59K/K99E/N200Q/C252S/K264E)_(GGGGS)2_Fc(216)_IgG1_pI(-
)_Isosteric_A_C220S/PVA_/S267K/L368D/K370S**
IWELKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSREKEDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK (SEQ ID NO: 789)

Chain 2 - human_IL12p35_(GGGGS)2_Fc(216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO: 781)

Figure 93

Untargeted Non-Xtend - Variants

\>XENP33468 human_IL12p40_E59K/K99E/N103Q/N113Q/N281Q/C252S/K264E_(GGGGS)2-
human_IL12p35_(GGGGS)2-Fc(216)_IgG1_pI(-
)_Isosteric_A_C220S/PVA_/S267K/L368D/K370S_Fc(216)_IgG1_C220S/PVA_/S267K/S364K/E357Q

**Chain 1 - human_IL12p40_E59K/K99E/N103Q/N113Q/N281Q/C252S/K264E_(GGGGS)2_Fc(216)_IgG1_pI(-
)_Isosteric_A_C220S/PVA_/S267K/L368D/K370S**
IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKQKTFLRCEAKQYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSREKEDRVFTDKTSATVICRKQASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVMHEALHNHYTQKSLSLSPGK (SEQ ID NO: 790)

Chain 2 - human_IL12p35_(GGGGS)2_Fc(216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVMHEALHNHYTQKSLSLSPGK (SEQ ID NO: 781)

Figure 94

Untargeted Xtend - Affinity Variants

>XENCXXX human_IL12p40(E59K)_(GGGGS)2-human_IL12p35_(GGGGS)2-Fc(216)_IgG1_pI(-
)_Isosteric_A_C220S/PVA_/S267K/L368D/K370S/M428L/N434S-
IgG1_PVA_/S267K/S364K/E357Q/M428L/N434S Chain 1 - human_IL12p40(E59K)_(GGGGS)2_Fc(216)_IgG1_pI(-
)_Isosteric_A_C220S/PVA_/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVLHEALHSHYTQKSLSLSPGK    (SEQ ID NO: 791)

Chain 2 - human_IL12p35_(GGGGS)2_IgG1_PVA_/S267K/S364K/E357Q/M428L/N434S
*RNLPVATPDPGMFPCLHHSQNLLRAVSNMLQKARQTLEFYPCTSEEIDHEDITKDKTSTVEACLPLELTKNESCL*
*NSRETSFITNGSCLASRKTSFMMALCLSSIYEDLKMYQVEFKTMNAKLLMDPKRQIFLDQNMLAVIDELMQALNF*
*NSETVPQKSSLEEPDFYKTKIKLCILLHAFRIRAVTIDRVMSYLNAS*/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVLHEALHSHYTQKSLSLSPGK    (SEQ ID NO:
792)

>XENP33680 human_IL12p40(D18K/E59K/K99E/K264E)_(GGGGS)2-human_IL12p35_(GGGGS)2-
Fc(216)_IgG1_pI(-
)_Isosteric_A_C220S/PVA_/S267K/L368D/K370S/M428L/N434S_Fc(216)_IgG1_C220S/PVA_/S267K/S364K/E
357Q/M428L/N434S Chain 1 - human_IL12p40(D18K/E59K/K99E/K264E)_(GGGGS)2_Fc(216)_IgG1_pI(-
)_Isosteric_A_C220S/PVA_/S267K/L368D/K370S/M428L/N434S
IWELKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKEDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVLHEALHSHYTQKSLSLSPGK   (SEQ ID NO: 793)

Chain 2 - human_IL12p35_(GGGGS)2_Fc(216)_IgG1_C220S/PVA_/S267K/S364K/E357Q/M428L/N434S
*RNLPVATPDPGMFPCLHHSQNLLRAVSNMLQKARQTLEFYPCTSEEIDHEDITKDKTSTVEACLPLELTKNESCL*
*NSRETSFITNGSCLASRKTSFMMALCLSSIYEDLKMYQVEFKTMNAKLLMDPKRQIFLDQNMLAVIDELMQALNF*
*NSETVPQKSSLEEPDFYKTKIKLCILLHAFRIRAVTIDRVMSYLNAS*/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVLHEALHSHYTQKSLSLSPGK    (SEQ ID NO:
794)

Figure 95A

Untargeted Xtend - Affinity Variants + C252S

>XENCXXX human_IL12p40(E59K/C252S)_(GGGGS)2-human_IL12p35_(GGGGS)2-Fc(216)_IgG1_pI(-)_Isosteric_A_C220S/PVA_/S267K/L368D/K370S/M428L/N434S-IgG1_PVA_/S267K/S364K/E357Q/M428L/N434S Chain 1 - human_IL12p40(E59K/C252S)_(GGGGS)2_Fc(216)_IgG1_pI(-)_Isosteric_A_C220S/PVA_/S267K/L368D/K370S/M428L/N434S IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVLHEALHSHYTQKSLSLSPGK (SEQ ID NO: 795)

Chain 2 - human_IL12p35_(GGGGS)2_IgG1_PVA_/S267K/S364K/E357Q/M428L/N434S

*RNLPVATPDPGMFPCLHHSQNLLRAVSNMLQKARQTLEFYPCTSEEIDHEDITKDKTSTVEACLPLELTKNESCL*
*NSRETSFITNGSCLASRKTSFMMALCLSSIYEDLKMYQVEFKTMNAKLLMDPKRQIFLDQNMLAVIDELMQALNF*
*NSETVPQKSSLEEPDFYKTKIKLCILLHAFRIRAVTIDRVMSYLNAS*/GGGGSGGGGS/*EPKSSDKTHTCPPCPA*
*PPVAGPSVFLFPPKPKDTLMISRTPEVTCVVVDVKHEDPEVKFNWYVDGVEVHNAKTKPREEQYNSTYRVVSVLT*
*VLHQDWLNGKEYKCKVSNKALPAPIEKTISKAKGQPREPQVYTLPPSREQMTKNQVKLTCLVKGFYPSDIAVEWE*
*SNGQPENNYKTTPPVLDSDGSFFLYSKLTVDKSRWQQGNVFSCSVLHEALHSHYTQKSLSLSPGK* (SEQ ID NO: 792)

>XENCXXX human_IL12p40(E59K/K99Y/C252S)_(GGGGS)2-human_IL12p35_(GGGGS)2-Fc(216)_IgG1_pI(-)_Isosteric_A_C220S/PVA_/S267K/L368D/K370S/M428L/N434S-IgG1_PVA_/S267K/S364K/E357Q/M428L/N434S Chain 1 - human_IL12p40(E59K/K99Y/C252S)_(GGGGS)2_Fc(216)_IgG1_pI(-)_Isosteric_A_C220S/PVA_/S267K/L368D/K370S/M428L/N434S IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQYEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVLHEALHSHYTQKSLSLSPGK (SEQ ID NO: 797)

Chain 2 - human_IL12p35_(GGGGS)2_IgG1_PVA_/S267K/S364K/E357Q/M428L/N434S

*RNLPVATPDPGMFPCLHHSQNLLRAVSNMLQKARQTLEFYPCTSEEIDHEDITKDKTSTVEACLPLELTKNESCL*
*NSRETSFITNGSCLASRKTSFMMALCLSSIYEDLKMYQVEFKTMNAKLLMDPKRQIFLDQNMLAVIDELMQALNF*
*NSETVPQKSSLEEPDFYKTKIKLCILLHAFRIRAVTIDRVMSYLNAS*/GGGGSGGGGS/*EPKSSDKTHTCPPCPA*
*PPVAGPSVFLFPPKPKDTLMISRTPEVTCVVVDVKHEDPEVKFNWYVDGVEVHNAKTKPREEQYNSTYRVVSVLT*
*VLHQDWLNGKEYKCKVSNKALPAPIEKTISKAKGQPREPQVYTLPPSREQMTKNQVKLTCLVKGFYPSDIAVEWE*
*SNGQPENNYKTTPPVLDSDGSFFLYSKLTVDKSRWQQGNVFSCSVLHEALHSHYTQKSLSLSPGK* (SEQ ID NO: 792)

Figure 95B

>XENCXXX_human_IL12p40(E59K/K99E/C252S)_(GGGGS)2-human_IL12p35_(GGGGS)2-Fc(216)_IgG1_pI(-)_Isosteric_A_C220S/PVA_/S267K/L368D/K370S/M428L/N434S-IgG1_PVA_/S267K/S364K/E357Q/M428L/N434S Chain 1 - human_IL12p40(E59K/K99E/C252S)_(GGGGS)2_Fc(216)_IgG1_pI(-)_Isosteric_A_C220S/PVA_/S267K/L368D/K370S/M428L/N434S IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/*GGGGSGGGGS*/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVLHEALHSHYTQKSLSLSPGK (SEQ ID NO: 798)

Chain 2 - human_IL12p35_(GGGGS)2_IgG1_PVA_/S267K/S364K/E357Q/M428L/N434S

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS*/*GGGGSGGGGS*/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVLHEALHSHYTQKSLSLSPGK (SEQ ID NO: 792)

>XENP33674_human_IL12p40(D18K/E59K/C252S/K99E)_(GGGGS)2-human_IL12p35_(GGGGS)2-Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S Chain 1 - human_IL12p40(D18K/E59K/C252S/K99E)_(GGGGS)2_Fc(216)_IgG1_pI(-)_Isosteric_A_C220S/PVA_/S267K/L368D/K370S/M428L/N434S IEWLKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/*GGGGSGGGGS*/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVLHEALHSHYTQKSLSLSPGK (SEQ ID NO: 799)

Chain 2 - human_IL12p35_(GGGGS)2_Fc(216)_IgG1_C220S/PVA_/S267K/S364K/E357Q/M428L/N434S RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/*GGGGSGGGGS*/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVLHEALHSHYTQKSLSLSPGK (SEQ ID NO: 800)

Figure 95C

>XENP33677 human_IL12p40(E59K/K99E/C252S/K264E)_(GGGGS)2-human_IL12p35_(GGGGS)2-
Fc(216)_IgG1_pI(-
)_Isosteric_A_C220S/PVA_/S267K/L368D/K370S/M428L/N434S_Fc(216)_IgG1_C220S/PVA_/S267K/S364K/E
357Q/M428L/N434S Chain 1 - human_IL12p40(E59K/K99E/C252S/K264E)_(GGGGS)2_Fc(216)_IgG1_pI(-
)_Isosteric_A_C220S/PVA_/S267K/L368D/K370S/M428L/N434S
IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVLHEALHSHYTQKSLSLSPGK (SEQ ID NO: 801)

Chain 2 - human_IL12p35_(GGGGS)2_Fc(216)_IgG1_C220S/PVA_/S267K/S364K/E357Q/M428L/N434S
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVLHEALHSHYTQKSLSLSPGK (SEQ ID NO: 794)

>XENP33681 human_IL12p40(D18K/E59K/K99E/C252S/K264E)_(GGGGS)2-human_IL12p35_(GGGGS)2-
Fc(216)_IgG1_pI(-
)_Isosteric_A_C220S/PVA_/S267K/L368D/K370S/M428L/N434S_Fc(216)_IgG1_C220S/PVA_/S267K/S364K/E
357Q/M428L/N434S Chain 1 - human_IL12p40(D18K/E59K/K99E/C252S/K264E)_(GGGGS)2_Fc(216)_IgG1_pI(-
)_Isosteric_A_C220S/PVA_/S267K/L368D/K370S/M428L/N434S
IWELKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVLHEALHSHYTQKSLSLSPGK (SEQ ID NO: 802)

Chain 2 - human_IL12p35_(GGGGS)2_Fc(216)_IgG1_C220S/PVA_/S267K/S364K/E357Q/M428L/N434S
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVLHEALHSHYTQKSLSLSPGK (SEQ ID NO: 794)

Figure 96A

Untargeted Xtend - Affinity Variants + N200Q

>XENCXXX human_IL12p40(E59K/N200Q)_(GGGGS)2-human_IL12p35_(GGGGS)2-Fc(216)_IgG1_pI(-)_Isosteric_A_C220S/PVA_/S267K/L368D/K370S/M428L/N434S-IgG1_PVA_/S267K/S364K/E357Q/M428L/N434S Chain 1 - human_IL12p40(E59K/N200Q)_(GGGGS)2_Fc(216)_IgG1_pI(-)_Isosteric_A_C220S/PVA_/S267K/L368D/K370S/M428L/N434S IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVLHEALHSHYTQKSLSLSPGK (SEQ ID NO: 803)

Chain 2 - human_IL12p35_(GGGGS)2_IgG1_PVA_/S267K/S364K/E357Q/M428L/N434S

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS*/GGGGSGGGGS/*EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVLHEALHSHYTQKSLSLSPGK* (SEQ ID NO: 792)

>XENCXXX human_IL12p40(E59K/K99Y/N200Q)_(GGGGS)2-human_IL12p35_(GGGGS)2-Fc(216)_IgG1_pI(-)_Isosteric_A_C220S/PVA_/S267K/L368D/K370S/M428L/N434S-IgG1_PVA_/S267K/S364K/E357Q/M428L/N434S Chain 1 - human_IL12p40(E59K/K99Y/N200Q)_(GGGGS)2_Fc(216)_IgG1_pI(-)_Isosteric_A_C220S/PVA_/S267K/L368D/K370S/M428L/N434S IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQYEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVLHEALHSHYTQKSLSLSPGK (SEQ ID NO: 804)

Chain 2 - human_IL12p35_(GGGGS)2_IgG1_PVA_/S267K/S364K/E357Q/M428L/N434S

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS*/GGGGSGGGGS/*EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVLHEALHSHYTQKSLSLSPGK* (SEQ ID NO: 792)

Figure 96B

>XENCXXX human_IL12p40(E59K/K99E/N200Q)_(GGGGS)2-human_IL12p35_(GGGGS)2-Fc(216)_IgG1_pI(-
)_Isosteric_A_C220S/PVA_/S267K/L368D/K370S/M428L/N434S-
IgG1_PVA_/S267K/S364K/E357Q/M428L/N434S Chain 1 - human_IL12p40(E59K/K99E/N200Q)_(GGGGS)2_Fc(216)_IgG1_pI(-
)_Isosteric_A_C220S/PVA_/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVLHEALHSHYTQKSLSLSPGK (SEQ ID NO: 805)

Chain 2 - human_IL12p35_(GGGGS)2_IgG1_PVA_/S267K/S364K/E357Q/M428L/N434S
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS*/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVLHEALHSHYTQKSLSLSPGK (SEQ ID NO:
792)

>XENP33675 human_IL12p40(D18K/E59K/K99E/N200Q)_(GGGGS)2-human_IL12p35_(GGGGS)2-
Fc(216)_IgG1_pI(-
)_Isosteric_A_C220S/PVA_/S267K/L368D/K370S/M428L/N434S_Fc(216)_IgG1_C220S/PVA_/S267K/S364K/E
357Q/M428L/N434S Chain 1 - human_IL12p40(D18K/E59K/K99E/N200Q)_(GGGGS)2_Fc(216)_IgG1_pI(-
)_Isosteric_A_C220S/PVA_/S267K/L368D/K370S/M428L/N434S
MGWSCIILFLVATATGVHSIWELKKDVYVVELDWYPKAPGEMVVLTCDTPEEDGITWTLDQSSEVLGSGKTLTIQ
VKKFGDAGQYTCHKGGEVLSHSLLLLHKKEDGIWSTDILKDQEEPKNKTFLRCEAKNYSGRFTCWWLTTISTDLT
FSVKSSRGSSDPQGVTCGAATLSAERVRGDNKEYEYSVECQEDSACPAAEESLPIEVMVDAVHKLKYEQYTSSFF
IRDIIKPDPPKNLQLKPLKNSRQVEVSWEYPDTWSTPHSYFSLTFCVQVQGKSKREKKDRVFTDKTSATVICRKN
ASISVRAQDRYYSSSWSEWASVPCS/GGGGSGGGGS/EPKSSDKTHTCPPCPAPPVAGPSVFLFPPKPKDTLMIS
RTPEVTCVVVDVKHEDPEVKFNWYVDGVEVHNAKTKPREEEYNSTYRVVSVLTVLHQDWLNGKEYKCKVSNKALP
APIEKTISKAKGQPREPQVYTLPPSREEMTKNQVSLTCDVSGFYPSDIAVEWESDGQPENNYKTTPPVLDSDGSF
FLYSKLTVDKSRWEQGDVFSCSVLHEALHSHYTQKSLSLSPGK (SEQ ID NO: 806)

Chain 2 - human_IL12p35_(GGGGS)2_Fc(216)_IgG1_C220S/PVA_/S267K/S364K/E357Q/M428L/N434S
*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS*/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVLHEALHSHYTQKSLSLSPGK (SEQ ID NO:
794)

Figure 96C

>XENP33678 human_IL12p40(E59K/K99E/N200Q/K264E)_(GGGGS)2-human_IL12p35_(GGGGS)2-
Fc(216)_IgG1_pI(-
)_Isosteric_A_C220S/PVA_/S267K/L368D/K370S/M428L/N434S_Fc(216)_IgG1_C220S/PVA_/S267K/S364K/E
357Q/M428L/N434S Chain 1 - human_IL12p40(E59K/K99E/N200Q/K264E)_(GGGGS)2_Fc(216)_IgG1_pI(-
)_Isosteric_A_C220S/PVA_/S267K/L368D/K370S/M428L/N434S
IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKEDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVLHEALHSHYTQKSLSLSPGK (SEQ ID NO: 807)

Chain 2 - human_IL12p35_(GGGGS)2_Fc(216)_IgG1_C220S/PVA_/S267K/S364K/E357Q/M428L/N434S
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVLHEALHSHYTQKSLSLSPGK (SEQ ID NO:
794)

>XENP33682 human_IL12p40(D18K/E59K/K99E/N200Q/K264E)_(GGGGS)2-human_IL12p35_(GGGGS)2-
Fc(216)_IgG1_pI(-
)_Isosteric_A_C220S/PVA_/S267K/L368D/K370S/M428L/N434S_Fc(216)_IgG1_C220S/PVA_/S267K/S364K/E
357Q/M428L/N434S Chain 1 - human_IL12p40(D18K/E59K/K99E/N200Q/K264E)_(GGGGS)2_Fc(216)_IgG1_pI(-
)_Isosteric_A_C220S/PVA_/S267K/L368D/K370S/M428L/N434S
IWELKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKEDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVLHEALHSHYTQKSLSLSPGK (SEQ ID NO: 808)

Chain 2 - human_IL12p35_(GGGGS)2_Fc(216)_IgG1_C220S/PVA_/S267K/S364K/E357Q/M428L/N434S
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVLHEALHSHYTQKSLSLSPGK (SEQ ID NO:
794)

Figure 97A

Untargeted Xtend - Affinity Variants + C252S + N200Q

>XENCXXX human_IL12p40(E59K/N200Q/C252S)_(GGGGS)2-human_IL12p35_(GGGGS)2-Fc(216)_IgG1_pI(-)_Isosteric_A_C220S/PVA_/S267K/L368D/K370S/M428L/N434S-IgG1_PVA_/S267K/S364K/E357Q/M428L/N434S Chain 1 - human_IL12p40(E59K/N200Q/C252S)_(GGGGS)2_Fc(216)_IgG1_pI(-)_Isosteric_A_C220S/PVA_/S267K/L368D/K370S/M428L/N434S IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVLHEALHSHYTQKSLSLSPGK (SEQ ID NO: 809)

Chain 2 - human_IL12p35_(GGGGS)2_IgG1_PVA_/S267K/S364K/E357Q/M428L/N434S

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS*/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVLHEALHSHYTQKSLSLSPGK (SEQ ID NO: 792)

>XENCXXX human_IL12p40(E59K/K99Y/N200Q/C252S)_(GGGGS)2-human_IL12p35_(GGGGS)2-Fc(216)_IgG1_pI(-)_Isosteric_A_C220S/PVA_/S267K/L368D/K370S/M428L/N434S-IgG1_PVA_/S267K/S364K/E357Q/M428L/N434S Chain 1 - human_IL12p40(E59K/K99Y/N200Q/C252S)_(GGGGS)2_Fc(216)_IgG1_pI(-)_Isosteric_A_C220S/PVA_/S267K/L368D/K370S/M428L/N434S IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQYEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVLHEALHSHYTQKSLSLSPGK (SEQ ID NO: 810)

Chain 2 - human_IL12p35_(GGGGS)2_IgG1_PVA_/S267K/S364K/E357Q/M428L/N434S

*RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS*/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVLHEALHSHYTQKSLSLSPGK (SEQ ID NO: 792)

Figure 97B

>XENCXXX_human_IL12p40(E59K/K99E/N200Q/C252S)_(GGGGS)2-human_IL12p35_(GGGGS)2-Fc(216)_IgG1_pI(-)_Isosteric_A_C220S/PVA_/S267K/L368D/K370S/M428L/N434S-IgG1_PVA_/S267K/S364K/E357Q/M428L/N434S Chain 1 - human_IL12p40(XXX)_(GGGGS)2_Fc(216)_IgG1_pI(-)_Isosteric_A_C220S/PVA_/S267K/L368D/K370S/M428L/N434S
IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVLHEALHSHYTQKSLSLSPGK (SEQ ID NO: 811)

Chain 2 - human_IL12p35_(GGGGS)2_IgG1_PVA_/S267K/S364K/E357Q/M428L/N434S
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVLHEALHSHYTQKSLSLSPGK (SEQ ID NO: 792)

>XENP33676_human_IL12p40(D18K/E59K/K99E/N200Q/C252S)_(GGGGS)2-human_IL12p35_(GGGGS)2-Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S Chain 1 - human_IL12p40(D18K/E59K/K99E/N200Q/C252S)_(GGGGS)2_Fc(216)_IgG1_pI(-)_Isosteric_A_C220S/PVA_/S267K/L368D/K370S/M428L/N434S
IWELKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVLHEALHSHYTQKSLSLSPGK (SEQ ID NO: 812)

Chain 2 - human_IL12p35_(GGGGS)2_Fc(216)_IgG1_C220S/PVA_/S267K/S364K/E357Q/M428L/N434S
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEEYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVLHEALHSHYTQKSLSLSPGK (SEQ ID NO: 794)

Figure 97C

>XENP33679 human_IL12p40(E59K/K99E/N200Q/C252S/K264E)_(GGGGS)2-human_IL12p35_(GGGGS)2-Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S Chain 1 - human_IL12p40(E59K/K99E/N200Q/C252S/K264E)_(GGGGS)2_Fc(216)_IgG1_pI(-)_Isosteric_A_C220S/PVA_/S267K/L368D/K370S/M428L/N434S
IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVLHEALHSHYTQKSLSLSPGK (SEQ ID NO: 813)

Chain 2 - human_IL12p35_(GGGGS)2_Fc(216)_IgG1_C220S/PVA_/S267K/S364K/E357Q/M428L/N434S
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVLHEALHSHYTQKSLSLSPGK (SEQ ID NO: 794)

>XENP33683 human_IL12p40(D18K/E59K/K99E/N200Q/C252S/K264E)_(GGGGS)2-human_IL12p35_(GGGGS)2-Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S Chain 1 - human_IL12p40(D18K/E59K/K99E/N200Q/C252S/K264E)_(GGGGS)2_Fc(216)_IgG1_pI(-)_Isosteric_A_C220S/PVA_/S267K/L368D/K370S/M428L/N434S
IWELKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS/GGGGSGGGGS/EPKSSDKTHTCPPCPAPPVAGPSVFLFPPKPKDTLMISRTPEVTCVVVDVKHEDPEV
KFNWYVDGVEVHNAKTKPREEEYNSTYRVVSVLTVLHQDWLNGKEYKCKVSNKALPAPIEKTISKAKGQPREPQV
YTLPPSREEMTKNQVSLTCDVSGFYPSDIAVEWESDGQPENNYKTTPPVLDSDGSFFLYSKLTVDKSRWEQGDVF
SCSVLHEALHSHYTQKSLSLSPGK (SEQ ID NO: 814)

Chain 2 - human_IL12p35_(GGGGS)2_Fc(216)_IgG1_C220S/PVA_/S267K/S364K/E357Q/M428L/N434S
RNLPVATPDPGMFPCLHHSQNLLRAVSNMLQKARQTLEFYPCTSEEIDHEDITKDKTSTVEACLPLELTKNESCL
NSRETSFITNGSCLASRKTSFMMALCLSSIYEDLKMYQVEFKTMNAKLLMDPKRQIFLDQNMLAVIDELMQALNF
NSETVPQKSSLEEPDFYKTKIKLCILLHAFRIRAVTIDRVMSYLNAS/GGGGSGGGGS/EPKSSDKTHTCPPCPA
PPVAGPSVFLFPPKPKDTLMISRTPEVTCVVVDVKHEDPEVKFNWYVDGVEVHNAKTKPREEQYNSTYRVVSVLT
VLHQDWLNGKEYKCKVSNKALPAPIEKTISKAKGQPREPQVYTLPPSREQMTKNQVKLTCLVKGFYPSDIAVEWE
SNGQPENNYKTTPPVLDSDGSFFLYSKLTVDKSRWQQGNVFSCSVLHEALHSHYTQKSLSLSPGK (SEQ ID NO: 794)

Figure 98A

PD-1 Targeted Non-Xtend - Affinity Variants

>XENCXXX_human_IL12p40(E59K)_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S-IgG1_PVA_/S267K/S364K/E357Q

Chain 1 - human_IL12p40(E59K)_(GGGGS)5-human_IL12p35_(GGGGS)2_(single-chain)_Fc(216)_IgG1_pI(-)_Isosteric_A_C220S/PVA_/S267K/L368D/K370S

IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/*GGGGSGGGGSGGGGSGGGGSGGGGS*/*RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 815)

Chain 2 - mAb C[PD-1]_H1IgG1_PVA_/S267K/S364K/E357Q

EVQLVESGGGLVQPGGSLRLSCAASGFTFSS<u>SFGMH</u>WVRQAPGKGLEWVS<u>YISSGSSIIYYADSVKG</u>RFTISRDNA
KNSLYLQMNSLRAEDTAVYYCAR<u>GGRLVWSFDY</u>WGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVMHEALHNHYTQKSLSLSPGK
(SEQ ID NO: 727)

Chain 3 - mAb C[PD-1]_L1.1

DIVMTQSPDSLAVSLGERATINCK<u>SSQSLLHSGNQKNYLT</u>WYQQKPGQPPKLLIY<u>WASTRES</u>GVPDRFTGSGSGT
DFTLTISSLQAEDVAVYYC<u>QNDYSYPFT</u>FGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC
(SEQ ID NO: 732)

Figure 98B

>XENCXXX_human_IL12p40(E59K/K99E)_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S-IgG1_PVA_/S267K/S364K/E357Q Chain 1 - human_IL12p40(E59K/K99E)_(GGGGS)5-human_IL12p35_(GGGGS)2_(single-chain)_Fc(216)_IgG1_pI(-)_Isosteric_A_C220S/PVA_/S267K/L368D/K370S IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/*GGGGSGGGGSGGGGSGGGGSGGGGS*/*RNLPVATPDPGMFPCLHHSQNLLRAVSNMLQKARQTLEFYPC*
*TSEEIDHEDITKDKTSTVEACLPLELTKNESCLNSRETSFITNGSCLASRKTSFMMALCLSSIYEDLKMYQVEFK*
*TMNAKLLMDPKRQIFLDQNMLAVIDELMQALNFNSETVPQKSSLEEPDFYKTKIKLCILLHAFRIRAVTIDRVMS*
*YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 818)

Chain 2 - mAb C[PD-1]_H1IgG1_PVA_/S267K/S364K/E357Q

EVQLVESGGGLVQPGGSLRLSCAASGFTFSSFGMHWVRQAPGKGLEWVSYISSGSSIIYYADSVKGRFTISRDNA
KNSLYLQMNSLRAEDTAVYYCARGGRLVWSPDYWGQGTLVTSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVMHEALHNHYTQKSLSLSPGK
(SEQ ID NO: 727)

Chain 3 - mAb C[PD-1]_L1.1

DIVMTQSPDSLAVSLGERATINCKSSQSLLHSGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC
(SEQ ID NO: 732)

Figure 99A

PD-1 Targeted Non-Xtend - Affinity Variants + C252S

>XENCXXX human_IL12p40(E59K/C252S)_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S-IgG1_PVA_/S267K/S364K/E357Q Chain 1 - human_IL12p40(E59K/C252S)_(GGGGS)5-human_IL12p35_(GGGGS)2_(single-chain)_Fc(216)_IgG1_pI(-)_Isosteric_A_C220S/PVA_/S267K/L368D/K370S IEWLKKDVYVVELDWYPDAPGEMVVLTCDTPEEDGITWTLDQSSEVLGSGKTLTIQVK<u>K</u>FGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTF<u>S</u>VQVQGKSKREKKDRVFTDKTSATVICRKNASISVRAQDRYYSSSWSEW
ASVPCS/<u>GGGGSGGGGSGGGGSGGGGSGGGGS</u>/*RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS*/<u>GGGGSGGGGS</u>/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK  (SEQ ID NO: 819)

Chain 2 - mAb C[PD-1]_H1IgG1_PVA_/S267K/S364K/E357Q

EVQLVESGGGLVQPGGSLRLSCAASGFTFS<u>SFGMH</u>WVRQAPGKGLEWVS<u>YISSGSSIIYYADSVKG</u>RFTISRDNA
KNSLYLQMNSLRAEDTAVYYCAR<u>GGRLVWSPDY</u>WGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVMHEALHNHYTQKSLSLSPGK
(SEQ ID NO: 727)

Chain 3 - mAb C[PD-1]_L1.1

DIVMTQSPDSLAVSLGERATINC<u>KSSQSLLASGNQKNYLT</u>WYQQKPGQPPKLLIY<u>WASTRES</u>GVPDRFTGSGSGT
DFTLTISSLQAEDVAVYYC<u>QNDYSYPFT</u>FGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC
(SEQ ID NO: 732)

>XENCXXX human_IL12p40(E59K/K99Y/C252S)_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S-IgG1_PVA_/S267K/S364K/E357Q Chain 1 - human_IL12p40(E59K/K99Y/C252S)_(GGGGS)5-human_IL12p35_(GGGGS)2_(single-chain)_Fc(216)_IgG1_pI(-)_Isosteric_A_C220S/PVA_/S267K/L368D/K370S IEWLKKDVYVVELDWYPDAPGEMVVLTCDTPEEDGITWTLDQSSEVLGSGKTLTIQVK<u>K</u>FGDAGQYTCHKGGEVL
SHSLLLLHKKEDGIWSTDILKDQ<u>Y</u>EPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTF<u>S</u>VQVQGKSKREKKDRVFTDKTSATVICRKNASISVRAQDRYYSSSWSEW
ASVPCS/<u>GGGGSGGGGSGGGGSGGGGSGGGGS</u>/*RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS*/<u>GGGGSGGGGS</u>/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK  (SEQ ID NO: 820)

Figure 99B

Chain 2 - mAb C[PD-1]_H1IgG1_PVA_/S267K/S364K/E357Q
EVQLVESGGGLVQPGGSLRLSCAASGFTFSSFGMHWVRQAPGKGLEWVSYISSGSSIIYYADSVKGRFTISRDNA
KNSLYLQMNSLRAEDTAVYYCARGGRLVWSPDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVMHEALHNHYTQKSLSLSPGK
(SEQ ID NO: 727)

Chain 3 - mAb C[PD-1]_L1.1
DIVMTQSPDSLAVSLGERATINCKSSQSLLHSGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC
(SEQ ID NO: 732)

>XENCXXX human_IL12p40(E59K/K99E/C252S)_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S-IgG1_PVA_/S267K/S364K/E357Q

Chain 1 - human_IL12p40(E59K/K99E/C252S)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 821)

Chain 2 - mAb C[PD-1]_H1IgG1_PVA_/S267K/S364K/E357Q
EVQLVESGGGLVQPGGSLRLSCAASGFTFSSFGMHWVRQAPGKGLEWVSYISSGSSIIYYADSVKGRFTISRDNA
KNSLYLQMNSLRAEDTAVYYCARGGRLVWSPDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVMHEALHNHYTQKSLSLSPGK
(SEQ ID NO: 727)

Chain 3 - mAb C[PD-1]_L1.1
DIVMTQSPDSLAVSLGERATINCKSSQSLLHSGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC
(SEQ ID NO: 732)

Figure 100A

PD-1 Targeted Non-Xtend - Affinity Variants + N200Q

>XENCXXX human_IL12p40(E59K/N200Q)_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S-IgG1_PVA_/S267K/S364K/E357Q Chain 1 - human_IL12p40(E59K/N200Q)_(GGGGS)5-human_IL12p35_(GGGGS)2_(single-chain)_Fc(216)_IgG1_pI(-)_Isosteric_A_C220S/PVA_/S267K/L368D/K370S IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK  (SEQ ID NO: 822)

Chain 2 - mAb C[PD-1]_H1IgG1_PVA_/S267K/S364K/E357Q

EVQLVESGGGLVQPGGSLRLSCAASGFTFSSFGMHWVRQAPGKGLEWVSYISSGSSIIYYADSVKGRFTISRDNA
KNSLYLQMNSLRAEDTAVYYCARGGRLVWSPDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVMHEALHNHYTQKSLSLSPGK
(SEQ ID NO: 727)

Chain 3 - mAb C[PD-1]_L1.1

DIVMTQSPDSLAVSLGERATINCKSSQSLLASGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC
(SEQ ID NO: 732)

>XENCXXX human_IL12p40(E59K/K99Y/N200Q)_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S-IgG1_PVA_/S267K/S364K/E357Q Chain 1 - human_IL12p40(E59K/K99Y/N200Q)_(GGGGS)5-human_IL12p35_(GGGGS)2_(single-chain)_Fc(216)_IgG1_pI(-)_Isosteric_A_C220S/PVA_/S267K/L368D/K370S IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQYEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK  (SEQ ID NO: 823)

Figure 100B

Chain 2 - mAb C[PD-1]_H1IgG1_PVA_/S267K/S364K/E357Q
EVQLVESGGGLVQPGGSLRLSCAASGFTFSSFGMHWVRQAPGKGLEWVSYISSGSSIIYYADSVKGRFTISRDNA
KNSLYLQMNSLRAEDTAVYYCARGGRLVWSPDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVMHEALHNHYTQKSLSLSPGK
(SEQ ID NO: 727)

Chain 3 - mAb C[PD-1]_L1.1
DIVMTQSPDSLAVSLGERATINCKSSQSLLHSGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC
(SEQ ID NO: 732)

>XENCXXX human_IL12p40(E59K/K99E/N200Q)_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S-IgG1_PVA_/S267K/S364K/E357Q

Chain 1 - human_IL12p40(E59K/K99E/N200Q)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGSGGGGSGGGGSGGGGS/RNLPVATPDGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 824)

Chain 2 - mAb C[PD-1]_H1IgG1_PVA_/S267K/S364K/E357Q
EVQLVESGGGLVQPGGSLRLSCAASGFTFSSFGMHWVRQAPGKGLEWVSYISSGSSIIYYADSVKGRFTISRDNA
KNSLYLQMNSLRAEDTAVYYCARGGRLVWSPDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVMHEALHNHYTQKSLSLSPGK
(SEQ ID NO: 727)

Chain 3 - mAb C[PD-1]_L1.1
DIVMTQSPDSLAVSLGERATINCKSSQSLLHSGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC
(SEQ ID NO: 732)

Figure 100C

>XENCXXX human_IL12p40(D18K/E59K/K99E/N200Q)_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S-IgG1_PVA_/S267K/S364K/E357Q Chain 1 - human_IL12p40(D18K/E59K/K99E/N200Q)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/*GGGGSGGGGSGGGGSGGGGSGGGGS*/*RNLPVATDPDGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 825)

Chain 2 - mAb C[PD-1]_H1IgG1_PVA_/S267K/S364K/E357Q
EVQLVESGGGLVQPGGSLRLSCAASGFTFSS<u>SFGMH</u>WVRQAPGKGLEWVS<u>YISSGSSIIYYADSVKG</u>RFTISRDNA
KNSLYLQMNSLRAEDTAVYYCAR<u>GGRLVWSPDY</u>WGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVMHEALHNHYTQKSLSLSPGK
(SEQ ID NO: 727)

Chain 3 - mAb C[PD-1]_L1.1
DIVMTQSPDSLAVSLGERATINC<u>KSSQSLLHSGNQKNYL</u>TWYQQKPGQPPKLLIY<u>WASTRES</u>GVPDRFTGSGSGT
DFTLTISSLQAEDVAVYYC<u>QNDYSYPFT</u>FGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC
(SEQ ID NO: 732)

>XENCXXX human_IL12p40(E59K/K99E/N200Q/K264E)_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S-IgG1_PVA_/S267K/S364K/E357Q Chain 1 - human_IL12p40(E59K/K99E/N200Q/K264E)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKEDRVFTDKTSATVICRKNASISVRAQDRYYSSSWSEW
ASVPCS/*GGGGSGGGGSGGGGSGGGGSGGGGS*/*RNLPVATDPDGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 826)

Figure 100D

Chain 2 - mAb C[PD-1]_H1IgG1_PVA_/S267K/S364K/E357Q
EVQLVESGGGLVQPGGSLRLSCAASGFTFSSFGMHWVRQAPGKGLEWVSYISSGSSIIYYADSVKGRFTISRDNA
KNSLYLQMNSLRAEDTAVYYCARGGRLVWSPDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVMHEALHNHYTQKSLSLSPGK
(SEQ ID NO: 727)

Chain 3 - mAb C[PD-1]_L1.1
DIVMTQSPDSLAVSLGERATINCKSSQSLLHSGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC
(SEQ ID NO: 732)

>XENP33686 human_IL12p40_D18K/E59K/K99E/N200Q/K264E_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S-IgG1_PVA_/S267K/S364K/E357Q

Chain 1 - human_IL12p40_D18K/E59K/K99E/N200Q/K264E_(GGGGS)5-human_IL12p35_(GGGGS)2_(single-chain)_Fc(216)_IgG1_pI(-)_Isosteric_A_C220S/PVA_/S267K/L368D/K370S
IWELKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKEDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 827)

Chain 2 - mAb C[PD-1]_H1_IgG1_PVA_/S267K/S364K/E357Q
EVQLVESGGGLVQPGGSLRLSCAASGFTFSSFGMHWVRQAPGKGLEWVSYISSGSSIIYYADSVKGRFTISRDNA
KNSLYLQMNSLRAEDTAVYYCARGGRLVWSPDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVMHEALHNHYTQKSLSLSPGK
(SEQ ID NO: 727)

Chain 3 - mAb C[PD-1]_L1.1 Light Chain
DIVMTQSPDSLAVSLGERATINCKSSQSLLHSGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC (SEQ ID NO: 829)

Figure 101A

PD-1 Targeted Non-Xtend - Affinity Variants + C252S + N200Q

>XENCXXX human_IL12p40(E59K/N200Q/C252S)_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S-IgG1_PVA_/S267K/S364K/E357Q Chain 1 - human_IL12p40(E59K/N200Q/C252S)_(GGGGS)5-human_IL12p35_(GGGGS)2_(single-chain)_Fc(216)_IgG1_pI(-)_Isosteric_A_C220S/PVA_/S267K/L368D/K370S IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWQEGDVFS
CSVMHEALHNHYTQKSLSLSPGK   (SEQ ID NO: 830)

Chain 2 - mAb C[PD-1]_H1IgG1_PVA_/S267K/S364K/E357Q

EVQLVESGGGLVQPGGSLRLSCAASGFTFSSFGMHWVRQAPGKGLEWVSYISSGSSIIYYADSVKGRFTISRDNA
KNSLYLQMNSLRAEDTAVYYCARGGRLVWSPDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVMHEALHNHYTQKSLSLSPGK
(SEQ ID NO: 727)

Chain 3 - mAb C[PD-1]_L1.1

DIVMTQSPDSLAVSLGERATINCKSSQSLLHSGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC
(SEQ ID NO: 732)

>XENCXXX human_IL12p40(E59K/K99Y/N200Q/C252S)_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S-IgG1_PVA_/S267K/S364K/E357Q Chain 1 - human_IL12p40(E59K/K99Y/N200Q/C252S)_(GGGGS)5-human_IL12p35_(GGGGS)2_(single-chain)_Fc(216)_IgG1_pI(-)_Isosteric_A_C220S/PVA_/S267K/L368D/K370S IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQYEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWQEGDVFS
CSVMHEALHNHYTQKSLSLSPGK   (SEQ ID NO: 831)

Figure 101B

Chain 2 - mAb C[PD-1]_H1IgG1_PVA_/S267K/S364K/E357Q
EVQLVESGGGLVQPGGSLRLSCAASGFTFSSFGMHWVRQAPGKGLEWVSYISSGSSIIYYADSVKGRFTISRDNA
KNSLYLQMNSLRAEDTAVYYCARGGRLVWSPDYWGQGTLVTSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVMHEALHNHYTQKSLSLSPGK
(SEQ ID NO: 727)

Chain 3 - mAb C[PD-1]_L1.1
DIVMTQSPDSLAVSLGERATINCKSSQSLLHSGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC
(SEQ ID NO: 732)

>XENCXXX human_IL12p40(E59K/K99E/N200Q/C252S)_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S-IgG1_PVA_/S267K/S364K/E357Q

Chain 1 - human_IL12p40(E59K/K99E/N200Q/C252S)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGSGGGGSGGGGSGGGGS/RNLPVATPDGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 832)

Chain 2 - mAb C[PD-1]_H1IgG1_PVA_/S267K/S364K/E357Q
EVQLVESGGGLVQPGGSLRLSCAASGFTFSSFGMHWVRQAPGKGLEWVSYISSGSSIIYYADSVKGRFTISRDNA
KNSLYLQMNSLRAEDTAVYYCARGGRLVWSPDYWGQGTLVTSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVMHEALHNHYTQKSLSLSPGK
(SEQ ID NO: 727)

Chain 3 - mAb C[PD-1]_L1.1
DIVMTQSPDSLAVSLGERATINCKSSQSLLHSGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC(SEQ
ID NO: 732)

Figure 101C

<u>>XENCXXX human_IL12p40(D18K/E59K/K99E/N200Q/C252S)_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S-IgG1_PVA_/S267K/S364K/E357Q</u>

Chain 1 - human_IL12p40(D18K/E59K/K99E/N200Q/C252S)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYP<u>K</u>APGEMVVLTCDTPEEDGITWTLDQSSEVLGSGKTLTIQVK<u>K</u>FGDAGQYTCHKGGEVL
SHSLLLLHKKEDGIWSTDILKDQ<u>E</u>EPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYE<u>Q</u>YTSSFFIRDIIKPDPPKNLQLKPLK
NSRQVEVSWEYPDTWSTPHSYFSLTF<u>S</u>VQVQGKSREKKDRVFTDKTSATVICRKNASISVRAQDRYYSSSWSEW
ASVPCS/<u>GGGGSGGGGSGGGGSGGGGSGGGGS</u>/*RNLPVATDPDGMFPCLHHSQNLLRAVSNMLQKARQTLEFYPC*
*TSEEIDHEDITKDKTSTVEACLPLELTKNESCLNSRETSFITNGSCLASRKTSFMMALCLSSIYEDLKMYQVEFK*
*TMNAKLLMDPKRQIFLDQNMLAVIDELMQALNFNSETVPQKSSLEEPDFYKTKIKLCILLHAFRIRAVTIDRVMS*
*YLNAS*/<u>GGGGSGGGGS</u>/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 834)

Chain 2 - mAb C[PD-1]_H1IgG1_PVA_/S267K/S364K/E357Q
EVQLVESGGGLVQPGGSLRLSCAASGFTFSS<u>FGMH</u>WVRQAPGKGLEWVS<u>YISSGSSIIYYADSVKG</u>RFTISRDNA
KNSLYLQMNSLRAEDTAVYYCAR<u>GGRLVWSPDY</u>WGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVMHEALHNHYTQKSLSLSPGK
(SEQ ID NO: 727)

Chain 3 - mAb C[PD-1]_L1.1
DIVMTQSPDSLAVSLGERATINC<u>KSSQSLLHSGNQKNYL</u>TWYQQKPGQPPKLLIY<u>WASTRES</u>GVPDRFTGSGSGT
DFTLTISSLQAEDVAVYYC<u>QNDYSYPFT</u>FGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC
(SEQ ID NO: 732)

<u>>XENCXXX human_IL12p40(E59K/K99E/N200Q/C252S/K264E)_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S-IgG1_PVA_/S267K/S364K/E357Q</u>

Chain 1 - human_IL12p40(E59K/K99E/N200Q/C252S/K264E)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVK<u>K</u>FGDAGQYTCHKGGEVL
SHSLLLLHKKEDGIWSTDILKDQ<u>E</u>EPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYE<u>Q</u>YTSSFFIRDIIKPDPPKNLQLKPLK
NSRQVEVSWEYPDTWSTPHSYFSLTF<u>S</u>VQVQGKSREK<u>E</u>DRVFTDKTSATVICRKNASISVRAQDRYYSSSWSEW
ASVPCS/<u>GGGGSGGGGSGGGGSGGGGSGGGGS</u>/*RNLPVATDPDGMFPCLHHSQNLLRAVSNMLQKARQTLEFYPC*
*TSEEIDHEDITKDKTSTVEACLPLELTKNESCLNSRETSFITNGSCLASRKTSFMMALCLSSIYEDLKMYQVEFK*
*TMNAKLLMDPKRQIFLDQNMLAVIDELMQALNFNSETVPQKSSLEEPDFYKTKIKLCILLHAFRIRAVTIDRVMS*
*YLNAS*/<u>GGGGSGGGGS</u>/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 835)

Figure 101D

Chain 2 - mAb C[PD-1]_H1IgG1_PVA_/S267K/S364K/E357Q
EVQLVESGGGLVQPGGSLRLSCAASGFTFSSFGMHWVRQAPGKGLEWVSYISSGSSIIYYADSVKGRFTISRDNA
KNSLYLQMNSLRAEDTAVYYCARGGRLVWSPDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVMHEALHNHYTQKSLSLSPGK
(SEQ ID NO: 727)

Chain 3 - mAb C[PD-1]_L1.1
DIVMTQSPDSLAVSLGERATINCKSSQSLLHSGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC
(SEQ ID NO: 732)

>XENP33687 human_IL12p40_D18K/E59K/K99E/N200Q/C252S/K264E_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S-IgG1_PVA_/S267K/S364K/E357Q

Chain 1 - human_IL12p40_D18K/E59K/K99E/N200Q/C252S/K264E_(GGGGS)5-human_IL12p35_(GGGGS)2_(single-chain)_Fc(216)_IgG1_pI(-)_Isosteric_A_C220S/PVA_/S267K/L368D/K370S
IWELKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 836)

Chain 2 - mAb C[PD-1]_H1_IgG1_PVA_/S267K/S364K/E357Q
EVQLVESGGGLVQPGGSLRLSCAASGFTFSSFGMHWVRQAPGKGLEWVSYISSGSSIIYYADSVKGRFTISRDNA
KNSLYLQMNSLRAEDTAVYYCARGGRLVWSPDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVMHEALHNHYTQKSLSLSPGK
(SEQ ID NO: 727)

Chain 3 - mAb C[PD-1]_L1.1 Light Chain
DIVMTQSPDSLAVSLGERATINCKSSQSLLHSGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC (SEQ ID NO: 829)

Figure 102A

PD-1 Targeted Xtend - Affinity Variants

>XENCXXX_human_IL12p40(E59K)_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S Chain 1 - human_IL12p40(E59K)_(GGGGS)5-human_IL12p35_(GGGGS)2_(single-chain)_Fc(216)_IgG1_pI(-)_Isosteric_A_C220S/PVA_/S267K/L368D/K370S/M428L/N434S IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/*GGGGSGGGGSGGGGSGGGGSGGGGS*/*RNLPVATPDPGMFPCLHHSQNLLRAVSNMLQKARQTLEFYPC*
*TSEEIDHEDITKDKTSTVEACLPLELTKNESCLNSRETSFITNGSCLASRKTSFMMALCLSSIYEDLKMYQVEFK*
*TMNAKLLMDPKRQIFLDQNMLAVIDELMQALNFNSETVPQKSSLEEPDFYKTKIKLCILLHAFRIRAVTIDRVMS*
*YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 837)

Chain 2 - mAb C[PD-1]_H1_IgG1_C220S/PVA_/S267K/S364K/E357Q/M428L/N434S
EVQLVESGGGLVQPGGSLRLSCAASGFTFSSFGMHWVRQAPGKGLEWVSYISSGSSIIYYADSVKGRFTISRDNA
KNSLYLQMNSLRAEDTAVYYCARGGRLVWSPDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVLHEALHSHYTQKSLSLSPGK
(SEQ ID NO: 744)

Chain 3 - mAb C[PD-1]_L1.1
DIVMTQSPDSLAVSLGERATINCKSSQGLLHSGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC (SEQ ID NO: 732)

>XENCXXX_human_IL12p40(E59K/K99E)_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S Chain 1 - human_IL12p40(E59K/K99E)_(GGGGS)5-human_IL12p35_(GGGGS)2_(single-chain)_Fc(216)_IgG1_pI(-)_Isosteric_A_C220S/PVA_/S267K/L368D/K370S/M428L/N434S IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/*GGGGSGGGGSGGGGSGGGGSGGGGS*/*RNLPVATPDPGMFPCLHHSQNLLRAVSNMLQKARQTLEFYPC*
*TSEEIDHEDITKDKTSTVEACLPLELTKNESCLNSRETSFITNGSCLASRKTSFMMALCLSSIYEDLKMYQVEFK*
*TMNAKLLMDPKRQIFLDQNMLAVIDELMQALNFNSETVPQKSSLEEPDFYKTKIKLCILLHAFRIRAVTIDRVMS*
*YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 839)

Figure 102B

Chain 2 - mAb C[PD-1]_H1_IgG1_C220S/PVA_/S267K/S364K/E357Q/M428L/N434S
EVQLVESGGGLVQPGGSLRLSCAASGFTFSSFGMHWVRQAPGKGLEWVSYISSGSSIIYYADSVKGRFTISRDNA
KNSLYLQMNSLRAEDTAVYYCARGGRLVWSPDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVLHEALHSHYTQKSLSLSPGK
(SEQ ID NO: 744)

Chain 3 - mAb C[PD-1]_L1.1
DIVMTQSPDSLAVSLGERATINCKSSQSLLHSGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC (SEQ
ID NO: 732)

>XENP33693 human_IL12p40_E59K/K99E/K264E_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S/M428L/N434S-IgG1_PVA_/S267K/S364K/E357Q/M428L/N434S

Chain 1 - human_IL12p40_E59K/K99E/K264E_(GGGGS)5-human_IL12p35_(GGGGS)2_(single-chain)_Fc(216)_IgG1_pI(-)_Isosteric_A_C220S/PVA_/S267K/L368D/K370S/M428L/N434S
IWELKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKEDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 743)

Chain 2 - mAb C[PD-1]_H1_IgG1_PVA_/S267K/S364K/E357Q/M428L/N434S
EVQLVESGGGLVQPGGSLRLSCAASGFTFSSFGMHWVRQAPGKGLEWVSYISSGSSIIYYADSVKGRFTISRDNA
KNSLYLQMNSLRAEDTAVYYCARGGRLVWSPDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVLHEALHSHYTQKSLSLSPGK
(SEQ ID NO: 737)

Chain 3 - mAb C[PD-1]_L1.1 Light Chain
DIVMTQSPDSLAVSLGERATINCKSSQSLLHSGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC
(SEQ ID NO: 829)

Figure 102C

>XENCXXX human_IL12p40(D18K/E59K/K99E)_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S

Chain 1 - human_IL12p40(D18K/E59K/K99E)_(GGGGS)5-human_IL12p35_(GGGGS)2_(single-chain)_Fc(216)_IgG1_pI(-)_Isosteric_A_C220S/PVA_/S267K/L368D/K370S/M428L/N434S

IEWLKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/*GGGGSGGGGSGGGGSGGGGSGGGGS*/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 842)

Chain 2 - mAb C[PD-1]_H1_IgG1_C220S/PVA_/S267K/S364K/E357Q/M428L/N434S

EVQLVESGGGLVQPGGSLRLSCAASGFTFSSFGMHWVRQAPGKGLEWVSYISSGSSIIYYADSVKGRFTISRDNA
KNSLYLQMNSLRAEDTAVYYCARGGKLVWSPDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVLHEALHSHYTQKSLSLSPGK
(SEQ ID NO: 744)

Chain 3 - mAb C[PD-1]_L1.1

DIVMTQSPDSLAVSLGERATINCKSSQSLLHSGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC (SEQ ID NO: 732)

Figure 102D

>XENP33694 human_IL12p40_D18K/E59K/K99E/K264E_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S/M428L/N434S-IgG1_PVA_/S267K/S364K/E357Q/M428L/N434S

Chain 1 - human_IL12p40_D18K/E59K/K99E/K264E_(GGGGS)5-human_IL12p35_(GGGGS)2_(single-chain)_Fc(216)_IgG1_pI(-)_Isosteric_A_C220S/PVA_/S267K/L368D/K370S/M428L/N434S
IWELKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKEDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 845)

Chain 2 - mAb C[PD-1]_H1_IgG1_PVA_/S267K/S364K/E357Q/M428L/N434S
EVQLVESGGGLVQPGGSLRLSCAASGFTFSSFGMHWVRQAPGKGLEWVSYISSGSSIIYYADSVKGRFTISRDNA
KNSLYLQMNSLRAEDTAVYYCARGGRLVWSPDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVLHEALHSHYTQKSLSLSPGK
(SEQ ID NO: 737)

Chain 3 - mAb C[PD-1]_L1.1 Light Chain
DIVMTQSPDSLAVSLGERATINCKSSQSLLHSGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC
(SEQ ID NO: 829)

Figure 103A

PD-1 Targeted Xtend - Affinity Variants + C252S

>XENCXXX human_IL12p40(E59K/C252S)_(GGGGS)5-human_IL12p35_(GGGGS)2_(single-chain)-mAb C[PD-
1]_H1_L1.1_Fc(216)_IgG1_pI(-
)_Isosteric_A_C220S/PVA_/S267K/L368D/K370S/M428L/N434S_Fc(216)_IgG1_C220S/PVA_/S267K/S364K/E
357Q/M428L/N434S Chain 1 - human_IL12p40(E59K/C252S)_(GGGGS)5-human_IL12p35_(GGGGS)2_(single-
chain)_Fc(216)_IgG1_pI(-)_Isosteric_A_C220S/PVA_/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGSGGGGSGGGGSGGGGS/RNLPVATPDGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK  (SEQ ID NO: 846)

Chain 2 - mAb C[PD-1]_H1_IgG1_C220S/PVA_/S267K/S364K/E357Q/M428L/N434S
EVQLVESGGGLVQPGGSLRLSCAASGFTFSSFGMHWVRQAPGKGLEWVSYISSGSSIIYYADSVKGRFTISRDNA
KNSLYLQMNSLRAEDTAVYYCARGGRLVWSPDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVLHEALHSHYTQKSLSLSPGK
(SEQ ID NO: 744)

Chain 3 - mAb C[PD-1]_L1.1
DIVMTQSPDSLAVSLGERATINCKSSQSLLHSGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC (SEQ
ID NO: 732)

>XENCXXX human_IL12p40(E59K/K99Y/C252S)_(GGGGS)5-human_IL12p35_(GGGGS)2_(single-chain)-mAb
C[PD-1]_H1_L1.1_Fc(216)_IgG1_pI(-
)_Isosteric_A_C220S/PVA_/S267K/L368D/K370S/M428L/N434S_Fc(216)_IgG1_C220S/PVA_/S267K/S364K/E
357Q/M428L/N434S
Chain 1 - human_IL12p40(E59K/K99Y/C252S)_(GGGGS)5-human_IL12p35_(GGGGS)2_(single-
chain)_Fc(216)_IgG1_pI(-)_Isosteric_A_C220S/PVA_/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQYEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGSGGGGSGGGGSGGGGS/RNLPVATPDGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 847)

Figure 103B

Chain 2 - mAb C[PD-1]_H1_IgG1_C220S/PVA_/S267K/S364K/E357Q/M428L/N434S
EVQLVESGGGLVQPGGSLRLSCAASGFTFSSFGMHWVRQAPGKGLEWVSYISSGSSIIYYADSVKGRFTISRDNA
KNSLYLQMNSLRAEDTAVYYCARGGRLVWSPDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVLHEALHSHYTQKSLSLSPGK
(SEQ ID NO: 744)

Chain 3 - mAb C[PD-1]_L1.1
DIVMTQSPDSLAVSLGERATINCKSSQSLLHSGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC (SEQ
ID NO: 732)

>XENCXXX human_IL12p40(E59K/K99E/C252S)_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S

Chain 1 - human_IL12p40(E59K/K99E/C252S)_(GGGGS)5-human_IL12p35_(GGGGS)2_(single-chain)_Fc(216)_IgG1_pI(-)_Isosteric_A_C220S/PVA_/S267K/L368D/K370S/M428L/N434S
IEWLKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 848)

Chain 2 - mAb C[PD-1]_H1_IgG1_C220S/PVA_/S267K/S364K/E357Q/M428L/N434S
EVQLVESGGGLVQPGGSLRLSCAASGFTFSSFGMHWVRQAPGKGLEWVSYISSGSSIIYYADSVKGRFTISRDNA
KNSLYLQMNSLRAEDTAVYYCARGGRLVWSPDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVLHEALHSHYTQKSLSLSPGK
(SEQ ID NO: 744)

Chain 3 - mAb C[PD-1]_L1.1
DIVMTQSPDSLAVSLGERATINCKSSQSLLHSGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC (SEQ
ID NO: 732)

Figure 103C

>XENCXXX human_IL12p40(D18K/E59K/K99E/C252S)_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S

Chain 1 - human_IL12p40(D18K/E59K/K99E/C252S)_(GGGGS)5-human_IL12p35_(GGGGS)2_(single-chain)_Fc(216)_IgG1_pI(-)_Isosteric_A_C220S/PVA_/S267K/L368D/K370S/M428L/N434S
IEWLKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/*GGGGSGGGGSGGGGSGGGGSGGGGS*/*RNLPVATPDPGMFPCLHHSQNLLRAVSNMLQKARQTLEFYPC*
*TSEEIDHEDITKDKTSTVEACLPLELTKNESCLNSRETSFITNGSCLASRKTSFMMALCLSSIYEDLKMYQVEFK*
*TMNAKLLMDPKRQIFLDQNMLAVIDELMQALNFNSETVPQKSSLEEPDFYKTKIKLCILLHAFRIRAVTIDRVMS*
*YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 849)

Chain 2 - mAb C[PD-1]_H1_IgG1_C220S/PVA_/S267K/S364K/E357Q/M428L/N434S
EVQLVESGGGLVQPGGSLRLSCAASGFTSSFGMHWVRQAPGKGLEWVSYISSGSSIIYYADSVKGRFTISRDNA
KNSLYLQMNSLRAEDTAVYYCARGGRLVWSPDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVLHEALHSHYTQKSLSLSPGK
(SEQ ID NO: 744)

Chain 3 - mAb C[PD-1]_L1.1
DIVMTQSPDSLAVSLGERATINCKSSQSLLHSGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC (SEQ ID NO: 732)

>XENCXXX human_IL12p40(E59K/K99E/C252S/K264E)_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S

Chain 1 - human_IL12p40(E59K/K99E/C252S/K264E)_(GGGGS)5-human_IL12p35_(GGGGS)2_(single-chain)_Fc(216)_IgG1_pI(-)_Isosteric_A_C220S/PVA_/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS/*GGGGSGGGGSGGGGSGGGGSGGGGS*/*RNLPVATPDPGMFPCLHHSQNLLRAVSNMLQKARQTLEFYPC*
*TSEEIDHEDITKDKTSTVEACLPLELTKNESCLNSRETSFITNGSCLASRKTSFMMALCLSSIYEDLKMYQVEFK*
*TMNAKLLMDPKRQIFLDQNMLAVIDELMQALNFNSETVPQKSSLEEPDFYKTKIKLCILLHAFRIRAVTIDRVMS*
*YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 850)

Figure 103D

Chain 2 - mAb C[PD-1]_H1_IgG1_C220S/PVA_/S267K/S364K/E357Q/M428L/N434S
EVQLVESGGGLVQPGGSLRLSCAASGFTFS<u>SFGMH</u>WVRQAPGKGLEWVS<u>YISSGSSIIYYADSVKG</u>RFTISRDNA
KNSLYLQMNSLRAEDTAVYYCAR<u>GGRLVWSPDY</u>WGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVLHEALHSHYTQKSLSLSPGK
(SEQ ID NO: 744)

Chain 3 - mAb C[PD-1]_L1.1
DIVMTQSPDSLAVSLGERATINC<u>KSSQSLLHSGNQKNYLT</u>WYQQKPGQPPKLLIY<u>WASTRES</u>GVPDRFTGSGSGT
DFTLTISSLQAEDVAVYYC<u>QNDYSYPFT</u>FGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC
(SEQ ID NO: 732)

<u>>XENP33695 human_IL12p40_D18K/E59K/K99E/C252S/K264E_(GGGGS)5-
human_IL12p35_(GGGGS)2_(single-chain)-mAb C[PD-1]_H1_L1.1_Fc(216)_IgG1_pI(-
)_Isosteric_A_C220S/PVA_/S267K/L368D/K370S/M428L/N434S-
IgG1_PVA_/S267K/S364K/E357Q/M428L/N434S</u>

Chain 1 - human_IL12p40_D18K/E59K/K99E/C252S/K264E_(GGGGS)5-human_IL12p35_(GGGGS)2_(single-chain)_Fc(216)_IgG1_pI(-)_Isosteric_A_C220S/PVA_/S267K/L368D/K370S/M428L/N434S
IWELKKDVYVVELDWYP<u>K</u>APGEMVVLTCDTPEEDGITWTLDQSSEVLGSGKTLTIQVK<u>K</u>FGDAGQYTCHKGGEVL
SHSLLLLHKKEDGIWSTDILKDQ<u>E</u>EPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTF<u>S</u>VQVQGKSKREK<u>E</u>DRVFTDKTSATVICRKNASISVRAQDRYYSSWSEW
ASVPCS/<u>GGGGSGGGGSGGGGSGGGGSGGGGS</u>/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/<u>GGGGSGGGGS</u>/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 851)

Chain 2 - mAb C[PD-1]_H1_IgG1_PVA_/S267K/S364K/E357Q/M428L/N434S
EVQLVESGGGLVQPGGSLRLSCAASGFTFS<u>SFGMH</u>WVRQAPGKGLEWVS<u>YISSGSSIIYYADSVKG</u>RFTISRDNA
KNSLYLQMNSLRAEDTAVYYCAR<u>GGRLVWSPDY</u>WGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVLHEALHSHYTQKSLSLSPGK
(SEQ ID NO: 737)

Chain 3 - mAb C[PD-1]_L1.1 Light Chain
DIVMTQSPDSLAVSLGERATINC<u>KSSQSLLHSGNQKNYLT</u>WYQQKPGQPPKLLIY<u>WASTRES</u>GVPDRFTGSGSGT
DFTLTISSLQAEDVAVYYC<u>QNDYSYPFT</u>FGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC
(SEQ ID NO: 829)

Figure 104A

PD-1 Targeted Xtend - Affinity Variants + N200Q

>XENCXXX human_IL12p40(E59K/N200Q)_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S
Chain 1 - human_IL12p40(E59K/N200Q)_(GGGGS)5-human_IL12p35_(GGGGS)2_(single-chain)_Fc(216)_IgG1_pI(-)_Isosteric_A_C220S/PVA_/S267K/L368D/K370S/M428L/N434S IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/*GGGGSGGGGSGGGGSGGGGSGGGGS*/*RNLPVATDPGMFPCLHHSQNLLRAVSNMLQKARQTLEFYPC*
*TSEEIDHEDITKDKTSTVEACLPLELTKNESCLNSRETSFITNGSCLASRKTSFMMALCLSSIYEDLKMYQVEFK*
*TMNAKLLMDPKRQIFLDQNMLAVIDELMQALNFNSETVPQKSSLEEPDFYKTKIKLCILLHAFRIRAVTIDRVMS*
*YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 852)

Chain 2 - mAb C[PD-1]_H1_IgG1_C220S/PVA_/S267K/S364K/E357Q/M428L/N434S

EVQLVESGGGLVQPGGSLRLSCAASGFTFSSSFGMEWVRQAPGKGLEWVSYISSGSSIIYYADSVKGRFTISRDNA
KNSLYLQMNSLRAEDTAVYYCARGGRLVWSPDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVLHEALHSHYTQKSLSLSPGK
(SEQ ID NO: 744)

Chain 3 - mAb C[PD-1]_L1.1

DIVMTQSPDSLAVSLGERATINCKSSQSLLHSGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC (SEQ
ID NO: 732)

>XENCXXX human_IL12p40(E59K/K99Y/N200Q)_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S
Chain 1 - human_IL12p40(E59K/K99Y/N200Q)_(GGGGS)5-human_IL12p35_(GGGGS)2_(single-chain)_Fc(216)_IgG1_pI(-)_Isosteric_A_C220S/PVA_/S267K/L368D/K370S/M428L/N434S IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQYEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/*GGGGSGGGGSGGGGSGGGGSGGGGS*/*RNLPVATDPGMFPCLHHSQNLLRAVSNMLQKARQTLEFYPC*
*TSEEIDHEDITKDKTSTVEACLPLELTKNESCLNSRETSFITNGSCLASRKTSFMMALCLSSIYEDLKMYQVEFK*
*TMNAKLLMDPKRQIFLDQNMLAVIDELMQALNFNSETVPQKSSLEEPDFYKTKIKLCILLHAFRIRAVTIDRVMS*
*YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 853)

Figure 104B

Chain 2 - mAb C[PD-1]_H1_IgG1_C220S/PVA_/S267K/S364K/E357Q/M428L/N434S
EVQLVESGGGLVQPGGSLRLSCAASGFTFSSFGMHWVRQAPGKGLEWVSYISSGSSIIYYADSVKGRFTISRDNA
KNSLYLQMNSLRAEDTAVYYCARGGRLVWSPDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVLHEALHSHYTQKSLSLSPGK
(SEQ ID NO: 744)

Chain 3 - mAb C[PD-1]_L1.1
DIVMTQSPDSLAVSLGERATINCKSSQSLLHSGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC (SEQ
ID NO: 732)

>XENCXXX human_IL12p40(E59K/K99E/N200Q)_(GGGGS)5-human_IL12p35_(GGGGS)2_(single-chain)-mAb
C[PD-1]_H1_L1.1_Fc(216)_IgG1_pI(-
)_Isosteric_A_C220S/PVA_/S267K/L368D/K370S/M428L/N434S_Fc(216)_IgG1_C220S/PVA_/S267K/S364K/E
357Q/M428L/N434S

Chain 1 - human_IL12p40(E59K/K99E/N200Q)_(GGGGS)5-human_IL12p35_(GGGGS)2_(single-chain)_Fc(216)_IgG1_pI(-)_Isosteric_A_C220S/PVA_/S267K/L368D/K370S/M428L/N434S
IEWLKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 854)

Chain 2 - mAb C[PD-1]_H1_IgG1_C220S/PVA_/S267K/S364K/E357Q/M428L/N434S
EVQLVESGGGLVQPGGSLRLSCAASGFTFSSFGMHWVRQAPGKGLEWVSYISSGSSIIYYADSVKGRFTISRDNA
KNSLYLQMNSLRAEDTAVYYCARGGRLVWSPDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVLHEALHSHYTQKSLSLSPGK
(SEQ ID NO: 744)

Chain 3 - mAb C[PD-1]_L1.1
DIVMTQSPDSLAVSLGERATINCKSSQSLLHSGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC (SEQ
ID NO: 732)

Figure 104C

>XENCXXX human_IL12p40(D18K/E59K/K99E/N200Q)_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S

Chain 1 - human_IL12p40(D18K/E59K/K99E/N200Q)_(GGGGS)5-human_IL12p35_(GGGGS)2_(single-chain)_Fc(216)_IgG1_pI(-)_Isosteric_A_C220S/PVA_/S267K/L368D/K370S/M428L/N434S
IEWLKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 855)

Chain 2 - mAb C[PD-1]_H1_IgG1_C220S/PVA_/S267K/S364K/E357Q/M428L/N434S
EVQLVESGGGLVQPGGSLRLSCAASGFTSSFGMHWVRQAPGKGLEWVSYISSGSSIIYYADSVKGRFTISRDNA
KNSLYLQMNSLRAEDTAVYYCARGGRLVWSPDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVLHEALHSHYTQKSLSLSPGK
(SEQ ID NO: 744)

Chain 3 - mAb C[PD-1]_L1.1
DIVMTQSPDSLAVSLGERATINCKSSQSLLHSGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC (SEQ
ID NO: 732)

>XENCXXX human_IL12p40(E59K/K99E/N200Q/K264E)_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S

Chain 1 - human_IL12p40(E59K/K99E/N200Q/K264E)_(GGGGS)5-human_IL12p35_(GGGGS)2_(single-chain)_Fc(216)_IgG1_pI(-)_Isosteric_A_C220S/PVA_/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKEDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 856)

Figure 104D

Chain 2 - mAb C[PD-1]_H1_IgG1_C220S/PVA_/S267K/S364K/E357Q/M428L/N434S
EVQLVESGGGLVQPGGSLRLSCAASGFTFSSFGMRWVRQAPGKGLEWVSYISSGSSIIYYADSVKGRFTISRDNA
KNSLYLQMNSLRAEDTAVYYCARGGRLVWSPDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVLHEALHSHYTQKSLSLSPGK
(SEQ ID NO: 744)

Chain 3 - mAb C[PD-1]_L1.1
DIVMTQSPDSLAVSLGERATINCKSSQSLLHSGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC (SEQ
ID NO: 732)

**>XENP33696 human_IL12p40_D18K/E59K/K99E/N200Q/K264E_(GGGGS)5-
human_IL12p35_(GGGGS)2_(single-chain)-mAb C[PD-1]_H1_L1.1_Fc(216)_IgG1_pI(-
)_Isosteric_A_C220S/PVA_/S267K/L368D/K370S/M428L/N434S-
IgG1_PVA_/S267K/S364K/E357Q/M428L/N434S**

**Chain 1 - human_IL12p40_D18K/E59K/K99E/N200Q/K264E_(GGGGS)5-human_IL12p35_(GGGGS)2_(single-
chain)_Fc(216)_IgG1_pI(-)_Isosteric_A_C220S/PVA_/S267K/L368D/K370S/M428L/N434S**
IWELKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKEDRVFTDKTSATVICRKNASISVRAQDRYYSSWSEW
ASVPCS/GGGGSGGGGSGGGGSGGGGSGGGGS/RNLPVATPDGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 857)

Chain 2 - mAb C[PD-1]_H1_IgG1_PVA_/S267K/S364K/E357Q/M428L/N434S
EVQLVESGGGLVQPGGSLRLSCAASGFTFSSFGMRWVRQAPGKGLEWVSYISSGSSIIYYADSVKGRFTISRDNA
KNSLYLQMNSLRAEDTAVYYCARGGRLVWSPDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVLHEALHSHYTQKSLSLSPGK
(SEQ ID NO: 737)

Chain 3 - mAb C[PD-1]_L1.1 Light Chain
DIVMTQSPDSLAVSLGERATINCKSSQSLLHSGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC
(SEQ ID NO: 829)

Figure 105A

PD-1 Targeted Xtend - Affinity Variants + C252S + N200Q

>XENCXXX human_IL12p40(E59K/N200Q/C252S)_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S Chain 1 - human_IL12p40(E59K/N200Q/C252S)_(GGGGS)5-human_IL12p35_(GGGGS)2_(single-chain)_Fc(216)_IgG1_pI(-)_Isosteric_A_C220S/PVA_/S267K/L368D/K370S/M428L/N434S IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGSGGGGSGGGGSGGGGS/RNLPVATDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK   (SEQ ID NO: 858)

Chain 2 - mAb C[PD-1]_H1_IgG1_C220S/PVA_/S267K/S364K/E357Q/M428L/N434S

EVQLVESGGGLVQPGGSLRLSCAASGFTFSSFGMHWVRQAPGKGLEWVSYISSGSSIIYYADSVKGRFTISRDNA
KNSLYLQMNSLRAEDTAVYYCARGGRLVWSPDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVLHEALHSHYTQKSLSLSPGK
(SEQ ID NO: 744)

Chain 3 - mAb C[PD-1]_L1.1

DIVMTQSPDSLAVSLGERATINCKSSQSLLHSGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC (SEQ ID NO: 732)

>XENCXXX human_IL12p40(E59K/K99Y/N200Q/C252S)_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S Chain 1 - human_IL12p40(E59K/K99Y/N200Q/C252S)_(GGGGS)5-human_IL12p35_(GGGGS)2_(single-chain)_Fc(216)_IgG1_pI(-)_Isosteric_A_C220S/PVA_/S267K/L368D/K370S/M428L/N434S IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQYEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGSGGGGSGGGGSGGGGS/RNLPVATDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK   (SEQ ID NO: 859)

Figure 105B

Chain 2 - mAb C[PD-1]_H1_IgG1_C220S/PVA_/S267K/S364K/E357Q/M428L/N434S
EVQLVESGGGLVQPGGSLRLSCAASGFTFSSFGMHWVRQAPGKGLEWVSYISSGSSIIYYADSVKGRFTISRDNA
KNSLYLQMNSLRAEDTAVYYCARGGRLVWSPDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVLHEALHSHYTQKSLSLSPGK
(SEQ ID NO: 744)

Chain 3 - mAb C[PD-1]_L1.1
DIVMTQSPDSLAVSLGERATINCKSSQSLLHSGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC (SEQ
ID NO: 732)

>XENCXXX human_IL12p40(E59K/K99E/N200Q/C252S)_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S

Chain 1 - human_IL12p40(E59K/K99E/N200Q/C252S)_(GGGGS)5-human_IL12p35_(GGGGS)2_(single-chain)_Fc(216)_IgG1_pI(-)_Isosteric_A_C220S/PVA_/S267K/L368D/K370S/M428L/N434S
IEWLKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGSGGGGSGGGGSGGGGS/RNLPVATPDFGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 860)

Chain 2 - mAb C[PD-1]_H1_IgG1_C220S/PVA_/S267K/S364K/E357Q/M428L/N434S
EVQLVESGGGLVQPGGSLRLSCAASGFTFSSFGMHWVRQAPGKGLEWVSYISSGSSIIYYADSVKGRFTISRDNA
KNSLYLQMNSLRAEDTAVYYCARGGRLVWSPDYWGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVLHEALHSHYTQKSLSLSPGK
(SEQ ID NO: 744)

Chain 3 - mAb C[PD-1]_L1.1
DIVMTQSPDSLAVSLGERATINCKSSQSLLHSGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC (SEQ
ID NO: 732)

Figure 105C

>XENCXXX human_IL12p40(D18K/E59K/K99E/N200Q/C252S)_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S

Chain 1 - human_IL12p40(D18K/E59K/K99E/N200Q/C252S)_(GGGGS)5-human_IL12p35_(GGGGS)2_(single-chain)_Fc(216)_IgG1_pI(-)_Isosteric_A_C220S/PVA_/S267K/L368D/K370S/M428L/N434S
IEWLKKDVYVVELDWYP<u>K</u>APGEMVVLTCDTPEEDGITWTLDQSSEVLGSGKTLTIQVK<u>K</u>FGDAGQYTCHKGGEVL
SHSLLLLHKKEDGIWSTDILKDQ<u>E</u>EPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYE<u>Q</u>YTSSFFIRDIIKPDPPKNLQLKPLK
NSRQVEVSWEYPDTWSTPHSYFSLTF<u>S</u>VQVQGKSKREKKDRVFTDKTSATVICRKNASISVRAQDRYYSSSWSEW
ASVPCS/<u>GGGGSGGGGSGGGGSGGGGSGGGGS</u>/*RNLPVATPDPGMFPCLHHSQNLLRAVSNMLQKARQTLEFYPC*
*TSEEIDHEDITKDKTSTVEACLPLELTKNESCLNSRETSFITNGSCLASRKTSFMMALCLSSIYEDLKMYQVEFK*
*TMNAKLLMDPKRQIFLDQNMLAVIDELMQALNFNSETVPQKSSLEEPDFYKTKIKLCILLHAFRIRAVTIDRVMS*
*YLNAS*/<u>GGGGSGGGGS</u>/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 861)

Chain 2 - mAb C[PD-1]_H1_IgG1_C220S/PVA_/S267K/S364K/E357Q/M428L/N434S
EVQLVESGGGLVQPGGSLRLSCAASGFTFSS<u>FGMH</u>WVRQAPGKGLEWVS<u>YISSGSSIIYYADSVKG</u>RFTISRDNA
KNSLYLQMNSLRAEDTAVYYCAR<u>GGRLVWSPDY</u>WGQGTLVTVSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVLHEALHSHYTQKSLSLSPGK
(SEQ ID NO: 744)

Chain 3 - mAb C[PD-1]_L1.1
DIVMTQSPDSLAVSLGERATINC<u>KSSQSLLHSGNQKNYLT</u>WYQQKPGQPPKLLIY<u>WASTRES</u>GVPDRFTGSGSGT
DFTLTISSLQAEDVAVYYC<u>QNDYSYPFT</u>FGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC (SEQ
ID NO: 732)

>XENCXXX human_IL12p40(E59K/K99E/N200Q/C252S/K264E)_(GGGGS)5-human_IL12p35_(GGGGS)2_(single-chain)-mAb C[PD-1]_H1_L1.1_Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S

Chain 1 - human_IL12p40(E59K/K99E/N200Q/C252S/K264E)_(GGGGS)5-human_IL12p35_(GGGGS)2_(single-chain)_Fc(216)_IgG1_pI(-)_Isosteric_A_C220S/PVA_/S267K/L368D/K370S/M428L/N434S
IEWLKKDVYVVELDWYPDAPGEMVVLTCDTPEEDGITWTLDQSSEVLGSGKTLTIQVK<u>K</u>FGDAGQYTCHKGGEVL
SHSLLLLHKKEDGIWSTDILKDQ<u>E</u>EPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYE<u>Q</u>YTSSFFIRDIIKPDPPKNLQLKPLK
NSRQVEVSWEYPDTWSTPHSYFSLTF<u>S</u>VQVQGKSKREK<u>E</u>DRVFTDKTSATVICRKNASISVRAQDRYYSSSWSEW
ASVPCS/<u>GGGGSGGGGSGGGGSGGGGSGGGGS</u>/*RNLPVATPDPGMFPCLHHSQNLLRAVSNMLQKARQTLEFYPC*
*TSEEIDHEDITKDKTSTVEACLPLELTKNESCLNSRETSFITNGSCLASRKTSFMMALCLSSIYEDLKMYQVEFK*
*TMNAKLLMDPKRQIFLDQNMLAVIDELMQALNFNSETVPQKSSLEEPDFYKTKIKLCILLHAFRIRAVTIDRVMS*
*YLNAS*/<u>GGGGSGGGGS</u>/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 862)

Figure 105D

Chain 2 - mAb C[PD-1]_H1_IgG1_C220S/PVA_/S267K/S364K/E357Q/M428L/N434S
EVQLVESGGGLVQPGGSLRLSCAASGFTFSSFGMRWVRQAPGKGLEWVSYISSGSSIIYYADSVKGRFTISRDNA
KNSLYLQMNSLRAEDTAVYYCARGGRLVWSPDYWGQGTLVTSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVLHEALHSHYTQKSLSLSPGK
(SEQ ID NO: 744)

Chain 3 - mAb C[PD-1]_L1.1
DIVMTQSPDSLAVSLGERATINCKSSQSLLHSGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC (SEQ
ID NO: 732)

**>XENP33697 human_IL12p40_D18K/E59K/K99E/N200Q/C252S/K264E_(GGGGS)5-
human_IL12p35_(GGGGS)2_(single-chain)-mAb C[PD-1]_H1_L1.1_Fc(216)_IgG1_pI(-
)_Isosteric_A_C220S/PVA_/S267K/L368D/K370S/M428L/N434S-
IgG1_PVA_/S267K/S364K/E357Q/M428L/N434S**

**Chain 1 - human_IL12p40_D18K/E59K/K99E/N200Q/C252S/K264E_(GGGGS)5-
human_IL12p35_(GGGGS)2_(single-chain)_Fc(216)_IgG1_pI(-
)_Isosteric_A_C220S/PVA_/S267K/L368D/K370S/M428L/N434S**
IWELKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 863)

Chain 2 - mAb C[PD-1]_H1_IgG1_PVA_/S267K/S364K/E357Q/M428L/N434S
EVQLVESGGGLVQPGGSLRLSCAASGFTFSSFGMRWVRQAPGKGLEWVSYISSGSSIIYYADSVKGRFTISRDNA
KNSLYLQMNSLRAEDTAVYYCARGGRLVWSPDYWGQGTLVTSS/ASTKGPSVFPLAPSSKSTSGGTAALGCLVK
DYFPEPVTVSWNSGALTSGVHTFPAVLQSSGLYSLSSVVTVPSSSLGTQTYICNVNHKPSNTKVDKKVEPKSCDK
THTCPPCPAPPVAGPSVFLFPPKPKDTLMISRTPEVTCVVVDVKHEDPEVKFNWYVDGVEVHNAKTKPREEQYNS
TYRVVSVLTVLHQDWLNGKEYKCKVSNKALPAPIEKTISKAKGQPREPQVYTLPPSREQMTKNQVKLTCLVKGFY
PSDIAVEWESNGQPENNYKTTPPVLDSDGSFFLYSKLTVDKSRWQQGNVFSCSVLHEALHSHYTQKSLSLSPGK
(SEQ ID NO: 737)

Chain 3 - mAb C[PD-1]_L1.1 Light Chain
DIVMTQSPDSLAVSLGERATINCKSSQSLLHSGNQKNYLTWYQQKPGQPPKLLIYWASTRESGVPDRFTGSGSGT
DFTLTISSLQAEDVAVYYCQNDYSYPFTFGSGTKLEIK/RTVAAPSVFIFPPSDEQLKSGTASVVCLLNNFYPRE
AKVQWKVDNALQSGNSQESVTEQDSKDSTYSLSSTLTLSKADYEKHKVYACEVTHQGLSSPVTKSFNRGEC
(SEQ ID NO: 829)

Figure 106

RSV Targeted Non-Xtend - Affinity Variants

<u>>XENCXXX human_IL12p40(E59K)_(GGGGS)5-human_IL12p35_(GGGGS)2_(single-chain)-
Numax_Fc(216)_IgG1_pI(-)_Isosteric_A_C220S/PVA_/S267K/L368D/K370S-IgG1_PVA_/S267K/S364K/E357Q</u>

Chain 1 - human_IL12p40(E59K)_(GGGGS)5-human_IL12p35_(GGGGS)2_(single-chain)_Fc(216)_IgG1_pI(-)_Isosteric_A_C220S/PVA_/S267K/L368D/K370S

IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/<u>GGGGSGGGGSGGGGSGGGGSGGGGS</u>/*RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS*/<u>GGGGSGGGGS</u>/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 815)

Chain 2 - Numax_VH_IgG1_PVA_/S267K/S364K/E357Q

QVTLRESGPALVKPTQTLTLTCTFSGFSLS<u>TAGMS</u>VGWIRQPPGKALEWLA<u>DIWWDDKKHYNPSLKD</u>RLTISKDT
SKNQVVLKVTNMDPADTATYYCARD<u>MIFNFYFD</u>VWGQGTTVTSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK
(SEQ ID NO: 754)

Chain 3 - Numax_LC

DIQMTQSPSTLSASVGDRVTITC<u>SASSRVGYMH</u>WYQQKPGKAPKLLIY<u>DTSKLAS</u>GVPSRFSGSGSGTEFTLTIS
SLQPDDFATYYC<u>FQGSGYPFT</u>FGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

Figure 107A

RSV Targeted Non-Xtend - Affinity Variants + C252S

<u>>XENCXXX human_IL12p40(E59K/C252S)_(GGGGS)5-human_IL12p35_(GGGGS)2_(single-chain)-Numax_Fc(216)_IgG1_pI(-)_Isosteric_A_C220S/PVA_/S267K/L368D/K370S-IgG1_PVA_/S267K/S364K/E357Q</u>

Chain 1 - human_IL12p40(E59K/C252S)_(GGGGS)5-human_IL12p35_(GGGGS)2_(single-chain)_Fc(216)_IgG1_pI(-)_Isosteric_A_C220S/PVA_/S267K/L368D/K370S IEWLKKDVYVVELDWYPDAPGEMVVLTCDTPEEDGITWTLDQSSEVLGSGKTLTIQVK<u>K</u>FGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTF<u>S</u>VQVQGKSKREKKDRVFTDKTSATVICRKNASISVRAQDRYYSSSWSEW
ASVPCS/<u>GGGGSGGGGSGGGGSGGGGSGGGGS</u>/*RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS*/<u>GGGGSGGGGS</u>/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 819)

Chain 2 - Numax_VH_IgG1_PVA_/S267K/S364K/E357Q

QVTLRESGPALVKPTQTLTLTCTFSGFSLS<u>TAGMSV</u>GWIRQPPGKALEWLA<u>DIWWDDKKHYNPSLKD</u>RLTISKDT
SKNQVVLKVTNMDPADTATYYCAR<u>DMIFNFYFDV</u>WGQGTTVTSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK
(SEQ ID NO: 754)

Chain 3 - Numax_LC

DIQMTQSPSTLSASVGDRVTITCS<u>ASSRVGYMH</u>WYQQKPGKAPKLLIY<u>DTSKLAS</u>GVPSRFSGSGSGTEFTLTIS
SLQPDDFATYYC<u>FQGSGYPFT</u>FGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

<u>>XENCXXX human_IL12p40(E59K/K99Y/C252S)_(GGGGS)5-human_IL12p35_(GGGGS)2_(single-chain)-Numax_Fc(216)_IgG1_pI(-)_Isosteric_A_C220S/PVA_/S267K/L368D/K370S-IgG1_PVA_/S267K/S364K/E357Q</u>

Chain 1 - human_IL12p40(E59K/K99Y/C252S)_(GGGGS)5-human_IL12p35_(GGGGS)2_(single-chain)_Fc(216)_IgG1_pI(-)_Isosteric_A_C220S/PVA_/S267K/L368D/K370S IEWLKKDVYVVELDWYPDAPGEMVVLTCDTPEEDGITWTLDQSSEVLGSGKTLTIQVK<u>K</u>FGDAGQYTCHKGGEVL
SHSLLLLHKKEDGIWSTDILKDQ<u>Y</u>EPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTF<u>S</u>VQVQGKSKREKKDRVFTDKTSATVICRKNASISVRAQDRYYSSSWSEW
ASVPCS/<u>GGGGSGGGGSGGGGSGGGGSGGGGS</u>/*RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS*/<u>GGGGSGGGGS</u>/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 820)

Figure 107B

Chain 2 - Numax_VH_IgG1_PVA_/S267K/S364K/E357Q
QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK
(SEQ ID NO: 754)

Chain 3 - Numax_LC
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

>XENCXXX human_IL12p40(E59K/K99E/C252S)_(GGGGS)5-human_IL12p35_(GGGGS)2_(single-chain)-Numax_Fc(216)_IgG1_pI(-)_Isosteric_A_C220S/PVA_/S267K/L368D/K370S-IgG1_PVA_/S267K/S364K/E357Q

Chain 1 - human_IL12p40(E59K/K99E/C252S)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 821)

Chain 2 - Numax_VH_IgG1_PVA_/S267K/S364K/E357Q
QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK
(SEQ ID NO: 754)

Chain 3 - Numax_LC
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

Figure 108A

RSV Targeted Non-Xtend - Affinity Variants + N200Q

>XENCXXX human_IL12p40(E59K/N200Q)_(GGGGS)5-human_IL12p35_(GGGGS)2_(single-chain)-Numax_Fc(216)_IgG1_pI(-)_Isosteric_A_C220S/PVA_/S267K/L368D/K370S-IgG1_PVA_/S267K/S364K/E357Q Chain 1 - human_IL12p40(E59K/N200Q)_(GGGGS)5-human_IL12p35_(GGGGS)2_(single-chain)_Fc(216)_IgG1_pI(-)_Isosteric_A_C220S/PVA_/S267K/L368D/K370S IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSREKKDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 822)

Chain 2 - Numax_VH_IgG1_PVA_/S267K/S364K/E357Q

QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK
(SEQ ID NO: 754)

Chain 3 - Numax_LC

DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

>XENCXXX human_IL12p40(E59K/K99Y/N200Q)_(GGGGS)5-human_IL12p35_(GGGGS)2_(single-chain)-Numax_Fc(216)_IgG1_pI(-)_Isosteric_A_C220S/PVA_/S267K/L368D/K370S-IgG1_PVA_/S267K/S364K/E357Q Chain 1 - human_IL12p40(E59K/K99Y/N200Q)_(GGGGS)5-human_IL12p35_(GGGGS)2_(single-chain)_Fc(216)_IgG1_pI(-)_Isosteric_A_C220S/PVA_/S267K/L368D/K370S IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQYEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSREKKDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 823)

Figure 108B

Chain 2 - Numax_VH_IgG1_PVA_/S267K/S364K/E357Q
QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK
(SEQ ID NO: 754)

Chain 3 - Numax_LC
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

>XENCXXX human_IL12p40(E59K/K99E/N200Q)_(GGGGS)5-human_IL12p35_(GGGGS)2_(single-chain)-Numax_Fc(216)_IgG1_pI(-)_Isosteric_A_C220S/PVA_/S267K/L368D/K370S-IgG1_PVA_/S267K/S364K/E357Q

Chain 1 - human_IL12p40(E59K/K99E/N200Q)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 824)

Chain 2 - Numax_VH_IgG1_PVA_/S267K/S364K/E357Q
QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK
(SEQ ID NO: 754)

Chain 3 - Numax_LC
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

Figure 108C

>XENCXXX_human_IL12p40(D18K/E59K/K99E/N200Q)_(GGGGS)5-human_IL12p35_(GGGGS)2_(single-chain)-Numax_Fc(216)_IgG1_pI(-)_Isosteric_A_C220S/PVA_/S267K/L368D/K370S-IgG1_PVA_/S267K/S364K/E357Q Chain 1 - human_IL12p40(D18K/E59K/K99E/N200Q)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/<u>GGGGSGGGGSGGGGSGGGGSGGGGS</u>/*RNLPVATPDPGMFPCLHHSQNLLRAVSNMLQKARQTLEFYPC*
*TSEEIDHEDITKDKTSTVEACLPLELTKNESCLNSRETSFITNGSCLASRKTSFMMALCLSSIYEDLKMYQVEFK*
*TMNAKLLMDPKRQIFLDQNMLAVIDELMQALNFNSETVPQKSSLEEPDFYKTKIKLCILLHAFRIRAVTIDRVMS*
*YLNAS*/<u>GGGGSGGGGS</u>/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 825)

Chain 2 - Numax_VH_IgG1_PVA_/S267K/S364K/E357Q
QVTLRESGPALVKPTQTLTLTCTFSGFSLST<u>AGMSVG</u>WIRQPPGKALEWLAD<u>IWWDDKKHYNPSLKDR</u>LTISKDT
SKNQVVLKVTNMDPADTATYYCARD<u>MIFNFYFDV</u>WGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK
(SEQ ID NO: 754)

Chain 3 - Numax_LC
DIQMTQSPSTLSASVGDRVTITC<u>SASSRVGYMH</u>WYQQKPGKAPKLLIY<u>DTSKLAS</u>GVPSRFSGSGSGTEFTLTIS
SLQPDDFATYYC<u>FQGSGYPFT</u>FGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

>XENCXXX_human_IL12p40(E59K/K99E/N200Q/K264E)_(GGGGS)5-human_IL12p35_(GGGGS)2_(single-chain)-Numax_Fc(216)_IgG1_pI(-)_Isosteric_A_C220S/PVA_/S267K/L368D/K370S-IgG1_PVA_/S267K/S364K/E357Q Chain 1 - human_IL12p40(E59K/K99E/N200Q/K264E)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKEDRVFTDKTSATVICRKNASISVRAQDRYYSSSWSEW
ASVPCS/<u>GGGGSGGGGSGGGGSGGGGSGGGGS</u>/*RNLPVATPDPGMFPCLHHSQNLLRAVSNMLQKARQTLEFYPC*
*TSEEIDHEDITKDKTSTVEACLPLELTKNESCLNSRETSFITNGSCLASRKTSFMMALCLSSIYEDLKMYQVEFK*
*TMNAKLLMDPKRQIFLDQNMLAVIDELMQALNFNSETVPQKSSLEEPDFYKTKIKLCILLHAFRIRAVTIDRVMS*
*YLNAS*/<u>GGGGSGGGGS</u>/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 826)

Figure 108D

Chain 2 - Numax_VH_IgG1_PVA_/S267K/S364K/E357Q
QVTLRESGPALVKPTQTLTLTCTFSGFSLSTAGMSVGWIRQPPGKALEWLADIWWDDKKRYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK
(SEQ ID NO: 754)

Chain 3 - Numax_LC
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

>XENP33684 human_IL12p40_D18K/E59K/K99E/N200Q/K264E_(GGGGS)5-human_IL12p35_(GGGGS)2_(single-chain)-Numax_Fc(216)_IgG1_pI(-)_Isosteric_A_C220S/PVA_/S267K/L368D/K370S-IgG1_PVA_/S267K/S364K/E357Q

Chain 1 - human_IL12p40_D18K/E59K/K99E/N200Q/K264E_(GGGGS)5-human_IL12p35_(GGGGS)2_(single-chain)_Fc(216)_IgG1_pI(-)_Isosteric_A_C220S/PVA_/S267K/L368D/K370S
IWELKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKEDRVFTDKTSATVICRKNASISVPAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 827)

Chain 2 - Numax_VH_IgG1_PVA_/S267K/S364K/E357Q
QVTLRESGPALVKPTQTLTLTCTFSGFSLSTAGMSVGWIRQPPGKALEWLADIWWDDKKRYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK
(SEQ ID NO: 754)

Chain 3 - Numax LC
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

Figure 109A

RSV Targeted Non-Xtend - Affinity Variants + C252S + N200Q

>XENCXXX_human_IL12p40(E59K/N200Q/C252S)_(GGGGS)5-human_IL12p35_(GGGGS)2_(single-chain)-Numax_Fc(216)_IgG1_pI(-)_Isosteric_A_C220S/PVA_/S267K/L368D/K370S-IgG1_PVA_/S267K/S364K/E357Q Chain 1 - human_IL12p40(E59K/N200Q/C252S)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGSGGGGSGGGGSGGGGS/*RNLPVATPDGMFPCLHHSQNLLRAVSNMLQKARQTLEFYPC*
*TSEEIDHEDITKDKTSTVEACLPLELTKNESCLNSRETSFITNGSCLASRKTSFMMALCLSSIYEDLKMYQVEFK*
*TMNAKLLMDPKRQIFLDQNMLAVIDELMQALNFNSETVPQKSSLEEPDFYKTKIKLCILLHAFRIRAVTIDRVMS*
*YLNAS*/GGGGSGGGGS/EPKSSDKTHTCPPCPAPPVAGPSVFLFPPKPKDTLMISRTPEVTCVVVDKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 830)

Chain 2 - Numax_VH_IgG1_PVA_/S267K/S364K/E357Q
QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK
(SEQ ID NO: 754)

Chain 3 - Numax_LC
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

>XENCXXX_human_IL12p40(E59K/K99Y/N200Q/C252S)_(GGGGS)5-human_IL12p35_(GGGGS)2_(single-chain)-Numax_Fc(216)_IgG1_pI(-)_Isosteric_A_C220S/PVA_/S267K/L368D/K370S-IgG1_PVA_/S267K/S364K/E357Q Chain 1 - human_IL12p40(E59K/K99Y/N200Q/C252S)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQYEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGSGGGGSGGGGSGGGGS/*RNLPVATPDGMFPCLHHSQNLLRAVSNMLQKARQTLEFYPC*
*TSEEIDHEDITKDKTSTVEACLPLELTKNESCLNSRETSFITNGSCLASRKTSFMMALCLSSIYEDLKMYQVEFK*
*TMNAKLLMDPKRQIFLDQNMLAVIDELMQALNFNSETVPQKSSLEEPDFYKTKIKLCILLHAFRIRAVTIDRVMS*
*YLNAS*/GGGGSGGGGS/EPKSSDKTHTCPPCPAPPVAGPSVFLFPPKPKDTLMISRTPEVTCVVVDKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 831)

Figure 109B

Chain 2 - Numax_VH_IgG1_PVA_/S267K/S364K/E357Q
QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK
(SEQ ID NO: 754)

Chain 3 - Numax_LC
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

>XENCXXX human_IL12p40(E59K/K99E/N200Q/C252S)_(GGGGS)5-human_IL12p35_(GGGGS)2_(single-chain)-Numax_Fc(216)_IgG1_pI(-)_Isosteric_A_C220S/PVA_/S267K/L368D/K370S-IgG1_PVA_/S267K/S364K/E357Q

Chain 1 - human_IL12p40(E59K/K99E/N200Q/C252S)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGSGGGGSGGGGSGGGGS/*RNLPVATPDGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS*/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 832)

Chain 2 - Numax_VH_IgG1_PVA_/S267K/S364K/E357Q
QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK
(SEQ ID NO: 754)

Chain 3 - Numax_LC
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

Figure 109C

>XENCXXX human_IL12p40(D18K/E59K/K99E/N200Q/C252S)_(GGGGS)5-human_IL12p35_(GGGGS)2_(single-chain)-Numax_Fc(216)_IgG1_pI(-)_Isosteric_A_C220S/PVA_/S267K/L368D/K370S-IgG1_PVA_/S267K/S364K/E357Q

Chain 1 - human_IL12p40(D18K/E59K/K99E/N200Q/C252S)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 834)

Chain 2 - Numax_VH_IgG1_PVA_/S267K/S364K/E357Q
QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK
(SEQ ID NO: 754)

Chain 3 - Numax_LC
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

>XENCXXX human_IL12p40(E59K/K99E/N200Q/C252S/K264E)_(GGGGS)5-human_IL12p35_(GGGGS)2_(single-chain)-Numax_Fc(216)_IgG1_pI(-)_Isosteric_A_C220S/PVA_/S267K/L368D/K370S-IgG1_PVA_/S267K/S364K/E357Q

Chain 1 - human_IL12p40(E59K/K99E/N200Q/C252S/K264E)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 835)

Figure 109D

Chain 2 - Numax_VH_IgG1_PVA_/S267K/S364K/E357Q
QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK
(SEQ ID NO: 754)

Chain 3 - Numax_LC
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

>XENP33685 human_IL12p40_D18K/E59K/K99E/N200Q/C252S/K264E_(GGGGS)5-human_IL12p35_(GGGGS)2_(single-chain)-Numax_Fc(216)_IgG1_pI(-)_Isosteric_A_C220S/PVA_/S267K/L368D/K370S-IgG1_PVA_/S267K/S364K/E357Q

Chain 1 - human_IL12p40_D18K/E59K/K99E/N200Q/C252S/K264E_(GGGGS)5-human_IL12p35_(GGGGS)2_(single-chain)_Fc(216)_IgG1_pI(-)_Isosteric_A_C220S/PVA_/S267K/L368D/K370S
IWELKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 836)

Chain 2 - Numax_VH_IgG1_PVA_/S267K/S364K/E357Q
QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVMHEALHNHYTQKSLSLSPGK
(SEQ ID NO: 754)

Chain 3 - Numax LC
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

Figure 110A

RSV Targeted Xtend - Affinity Variants

>XENCXXX human_IL12p40(E59K)_(GGGGS)5-human_IL12p35_(GGGGS)2_(single-chain)-
Numax_Fc(216)_IgG1_pI(-
)_Isosteric_A_C220S/PVA_/S267K/L368D/K370S/M428L/N434S_Fc(216)_IgG1_C220S/PVA_/S267K/S364K/E
357Q/M428L/N434S
Chain 1 - human_IL12p40(E59K)_(GGGGS)5-human_IL12p35_(GGGGS)2_(single-chain)_Fc(216)_IgG1_pI(-
)_Isosteric_A_C220S/PVA_/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/_GGGGSGGGGSGGGGSGGGGSGGGGS_/_RNLPVATPDPGMFPCLHHSQNLLRAVSNMLQKARQTLEFYPC_
_TSEEIDHEDITKDKTSTVEACLPLELTKNESCLNSRETSFITNGSCLASRKTSFMMALCLSSIYEDLKMYQVEFK_
_TMNAKLLMDPKRQIFLDQNMLAVIDELMQALNFNSETVPQKSSLEEPDFYKTKIKLCILLHAFRIRAVTIDRVMS_
_YLNAS_/_GGGGSGGGGS_/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 837)

Chain 2 - Numax_VH_IgG1_C220S/PVA_/S267K/S364K/E357Q/M428L/N434S
QVTLRESGPALVKPTQTLTLTCTFSGFSLST_AGMSV_GWIRQPPGKALEWLAD_IWWDDKKHYNPSLKD_RLTISKDT
SKNQVVLKVTNMDPADTATYYCARD_MIFNFYFDV_WGQGTTVTSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVLHEALHSHYTQKSLSLSPGK
(SEQ ID NO: 759)

Chain 3 - Numax LC
DIQMTQSPSTLSASVGDRVTITC_SASSSVGYMH_WYQQKPGKAPKLLIY_DTSKLAS_GVPSRFSGSGSGTEFTLTIS
SLQPDDFATYYC_FQGSGYPFT_FGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO:
755)

>XENCXXX human_IL12p40(E59K/K99Y)_(GGGGS)5-human_IL12p35_(GGGGS)2_(single-chain)-
Numax_Fc(216)_IgG1_pI(-
)_Isosteric_A_C220S/PVA_/S267K/L368D/K370S/M428L/N434S_Fc(216)_IgG1_C220S/PVA_/S267K/S364K/E
357Q/M428L/N434S
Chain 1 - human_IL12p40(E59K/K99Y)_(GGGGS)5-human_IL12p35_(GGGGS)2_(single-
chain)_Fc(216)_IgG1_pI(-)_Isosteric_A_C220S/PVA_/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQYEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/_GGGGSGGGGSGGGGSGGGGSGGGGS_/_RNLPVATPDPGMFPCLHHSQNLLRAVSNMLQKARQTLEFYPC_
_TSEEIDHEDITKDKTSTVEACLPLELTKNESCLNSRETSFITNGSCLASRKTSFMMALCLSSIYEDLKMYQVEFK_
_TMNAKLLMDPKRQIFLDQNMLAVIDELMQALNFNSETVPQKSSLEEPDFYKTKIKLCILLHAFRIRAVTIDRVMS_
_YLNAS_/_GGGGSGGGGS_/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 870)

Figure 110B

Chain 2 - Numax_VH_IgG1_C220S/PVA_/S267K/S364K/E357Q/M428L/N434S
QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVLHEALHSHYTQKSLSLSPGK
(SEQ ID NO: 759)

Chain 3 - Numax LC
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

>XENP33688 human_IL12p40_E59K/K99E/K264E_(GGGGS)5-human_IL12p35_(GGGGS)2_(single-chain)-Numax_Fc(216)_IgG1_pI(-)_Isosteric_A_C220S/PVA_/S267K/L368D/K370S/M428L/N434S-IgG1_PVA_/S267K/S364K/E357Q/M428L/N434S

Chain 1 - human_IL12p40_E59K/K99E/K264E_(GGGGS)5-human_IL12p35_(GGGGS)2_(single-chain)_Fc(216)_IgG1_pI(-)_Isosteric_A_C220S/PVA_/S267K/L368D/K370S/M428L/N434S
IWELKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKEDRVFTDKTSATVICRKNASISVPAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 743)

Chain 2 - Numax_VH_IgG1_PVA_/S267K/S364K/E357Q/M428L/N434S
QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVLHEALHSHYTQKSLSLSPGK
(SEQ ID NO: 758)

Chain 3 - Numax LC
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

Figure 110C

>XENCXXX_human_IL12p40(D18K/E59K/K99E)_(GGGGS)5-human_IL12p35_(GGGGS)2_(single-chain)-Numax_Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S Chain 1 - human_IL12p40(D18K/E59K/K99E)_(GGGGS)5-human_IL12p35_(GGGGS)2_(single-chain)_Fc(216)_IgG1_pI(-)_Isosteric_A_C220S/PVA_/S267K/L368D/K370S/M428L/N434S IEWLKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSWSEW
ASVPCS/<u>GGGGSGGGGSGGGGSGGGGSGGGGS</u>/*RNLPVATPDPGMFPCLHHSQNLLRAVSNMLQKARQTLEFYPC*
*TSEEIDHEDITKDKTSTVEACLPLELTKNESCLNSRETSFITNGSCLASRKTSFMMALCLSSIYEDLKMYQVEFK*
*TMNAKLLMDPKRQIFLDQNMLAVIDELMQALNFNSETVPQKSSLEEPDFYKTKIKLCILLHAFRIRAVTIDRVMS*
*YLNAS*/<u>GGGGSGGGGS</u>/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 842)

Chain 2 - Numax_VH_IgG1_C220S/PVA_/S267K/S364K/E357Q/M428L/N434S
QVTLRESGPALVKPTQTLTLTCTFSGFSLS<u>TAGMS</u>VGWIRQPPGKALEWLAD<u>IWWDDKKHYNPSLKD</u>RLTISKDT
SKNQVVLKVTNMDPADTATYYCARD<u>MIFNFYFD</u>VWGQGTTVTSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVLHEALHSHYTQKSLSLSPGK
(SEQ ID NO: 759)

Chain 3 - Numax LC
DIQMTQSPSTLSASVGDRVTITC<u>SASSRVGYMH</u>WYQQKPGKAPKLLIY<u>DTSKLAS</u>GVPSRFSGSGSGTEFTLTIS
SLQPDDFATYYC<u>FQGSGYPFT</u>FGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

>XENP33689_human_IL12p40_D18K/E59K/K99E/K264E_(GGGGS)5-human_IL12p35_(GGGGS)2_(single-chain)-Numax_Fc(216)_IgG1_pI(-)_Isosteric_A_C220S/PVA_/S267K/L368D/K370S/M428L/N434S-IgG1_PVA_/S267K/S364K/E357Q/M428L/N434S Chain 1 - human_IL12p40_D18K/E59K/K99E/K264E_(GGGGS)5-human_IL12p35_(GGGGS)2_(single-chain)_Fc(216)_IgG1_pI(-)_Isosteric_A_C220S/PVA_/S267K/L368D/K370S/M428L/N434S IWELKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKEDRVFTDKTSATVICRKNASISVRAQDRYYSSWSEW
ASVPCS/<u>GGGGSGGGGSGGGGSGGGGSGGGGS</u>/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/<u>GGGGSGGGGS</u>/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 845)

Figure 110D

Chain 2 - Numax_VH_IgG1_PVA_/S267K/S364K/E357Q/M428L/N434S
QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVLHEALHSHYTQKSLSLSPGK
(SEQ ID NO: 758)

Chain 3 - Numax LC
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

Figure 111A

RSV Targeted Xtend - Affinity Variants + C252S

>XENCXXX human_IL12p40(E59K/C252S)_(GGGGS)5-human_IL12p35_(GGGGS)2_(single-chain)-Numax_Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S Chain 1 - human_IL12p40(E59K/C252S)_(GGGGS)5-human_IL12p35_(GGGGS)2_(single-chain)_Fc(216)_IgG1_pI(-)_Isosteric_A_C220S/PVA_/S267K/L368D/K370S/M428L/N434S IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/*GGGGSGGGGSGGGGSGGGGSGGGGS*/*RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 846)

Chain 2 - Numax_VH_IgG1_C220S/PVA_/S267K/S364K/E357Q/M428L/N434S

QVTLRESGPALVKPTQTLTLTCTFSGFSLS*TAGMSVG*WIRQPPGKALEWLAD*IWWDDKKHYNPSLKD*RLTISKDT
SKNQVVLKVTNMDPADTATYYCARD*MIFNFYFDV*WGQGTTVTSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVLHEALHSHYTQKSLSLSPGK
(SEQ ID NO: 759)

Chain 3 - Numax LC

DIQMTQSPSTLSASVGDRVTITC*SASSSVGYMH*WYQQKPGKAPKLLIY*DTSKLAS*GVPSRFSGSGSGTEFTLTIS
SLQPDDFATYYC*FQGSGYPFT*FGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

>XENCXXX human_IL12p40(E59K/K99Y/C252S)_(GGGGS)5-human_IL12p35_(GGGGS)2_(single-chain)-Numax_Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S Chain 1 - human_IL12p40(E59K/K99Y/C252S)_(GGGGS)5-human_IL12p35_(GGGGS)2_(single-chain)_Fc(216)_IgG1_pI(-)_Isosteric_A_C220S/PVA_/S267K/L368D/K370S/M428L/N434S IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQYEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/*GGGGSGGGGSGGGGSGGGGSGGGGS*/*RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 847)

Figure 111B

Chain 2 - Numax_VH_IgG1_C220S/PVA_/S267K/S364K/E357Q/M428L/N434S
QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVLHEALHSHYTQKSLSLSPGK
(SEQ ID NO: 759)

Chain 3 - Numax LC
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

>XENCXXX human_IL12p40(E59K/K99E/C252S)_(GGGGS)5-human_IL12p35_(GGGGS)2_(single-chain)-Numax_Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S

Chain 1 - human_IL12p40(E59K/K99E/C252S)_(GGGGS)5-human_IL12p35_(GGGGS)2_(single-chain)_Fc(216)_IgG1_pI(-)_Isosteric_A_C220S/PVA_/S267K/L368D/K370S/M428L/N434S
IEWLKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 848)

Chain 2 - Numax_VH_IgG1_C220S/PVA_/S267K/S364K/E357Q/M428L/N434S
QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVLHEALHSHYTQKSLSLSPGK
(SEQ ID NO: 759)

Chain 3 - Numax LC
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

Figure 111C

>XENCXXX_human_IL12p40(D18K/E59K/K99E/C252S)_(GGGGS)5-human_IL12p35_(GGGGS)2_(single-chain)-Numax_Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S

Chain 1 - human_IL12p40(D18K/E59K/K99E/C252S)_(GGGGS)5-human_IL12p35_(GGGGS)2_(single-chain)_Fc(216)_IgG1_pI(-)_Isosteric_A_C220S/PVA_/S267K/L368D/K370S/M428L/N434S
IEWLKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/*GGGGSGGGGSGGGGSGGGGSGGGGS*/*RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 849)

Chain 2 - Numax_VH_IgG1_C220S/PVA_/S267K/S364K/E357Q/M428L/N434S
QVTLRESGPALVKPTQTLTLTCTFSGFSLSTAGMSVGWIRQPPGKALEWLADIWDDKKYYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVLHEALHSHYTQKSLSLSPGK
(SEQ ID NO: 759)

Chain 3 - Numax LC
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

>XENCXXX_human_IL12p40(E59K/K99E/C252S/K264E)_(GGGGS)5-human_IL12p35_(GGGGS)2_(single-chain)-Numax_Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S

Chain 1 - human_IL12p40(E59K/K99E/C252S/K264E)_(GGGGS)5-human_IL12p35_(GGGGS)2_(single-chain)_Fc(216)_IgG1_pI(-)_Isosteric_A_C220S/PVA_/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS/*GGGGSGGGGSGGGGSGGGGSGGGGS*/*RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 850)

Figure 111D

Chain 2 - Numax_VH_IgG1_C220S/PVA_/S267K/S364K/E357Q/M428L/N434S
QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVLHEALHSHYTQKSLSLSPGK
(SEQ ID NO: 759)

Chain 3 - Numax LC
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

>XENP33690 human_IL12p40_D18K/E59K/K99E/C252S/K264E_(GGGGS)5-human_IL12p35_(GGGGS)2_(single-chain)-Numax_Fc(216)_IgG1_pI(-)_Isosteric_A_C220S/PVA_/S267K/L368D/K370S/M428L/N434S-IgG1_PVA_/S267K/S364K/E357Q/M428L/N434S

Chain 1 - human_IL12p40_D18K/E59K/K99E/C252S/K264E_(GGGGS)5-human_IL12p35_(GGGGS)2_(single-chain)_Fc(216)_IgG1_pI(-)_Isosteric_A_C220S/PVA_/S267K/L368D/K370S/M428L/N434S
IWELKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSWSEW
ASVPCS/GGGGSGGGGSGGGGSGGGGSGGGGS/RNLPVATPDGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 851)

Chain 2 - Numax_VH_IgG1_PVA_/S267K/S364K/E357Q/M428L/N434S
QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVLHEALHSHYTQKSLSLSPGK
(SEQ ID NO: 758)

Chain 3 - Numax LC
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

Figure 112A

RSV Targeted Xtend - Affinity Variants + N200Q

>XENCXXX human_IL12p40(E59K/N200Q)_(GGGGS)5-human_IL12p35_(GGGGS)2_(single-chain)-
Numax_Fc(216)_IgG1_pI(-
)_Isosteric_A_C220S/PVA_/S267K/L368D/K370S/M428L/N434S_Fc(216)_IgG1_C220S/PVA_/S267K/S364K/E
357Q/M428L/N434S
Chain 1 - human_IL12p40(E59K/N200Q)_(GGGGS)5-human_IL12p35_(GGGGS)2_(single-
chain)_Fc(216)_IgG1_pI(-)_Isosteric_A_C220S/PVA_/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/*GGGGSGGGGSGGGGSGGGGSGGGGS*/*RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 852)

Chain 2 - Numax_VH_IgG1_C220S/PVA_/S267K/S364K/E357Q/M428L/N434S
QVTLRESGPALVKPTQTLTLTCTFSGFSLS*TAGMSV*GWIRQPPGKALEWLAD*IWWDDKKHYNPSLK*DRLTISKDT
SKNQVVLKVTNMDPADTATYYCARD*MIFNFYFDV*WGQGTTVTSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVLHEALHSHYTQKSLSLSPGK
(SEQ ID NO: 759)

Chain 3 - Numax LC
DIQMTQSPSTLSASVGDRVTITC*SASSSVGYMH*WYQQKPGKAPKLLIY*DTSKLAS*GVPSRFSGSGSGTEFTLTIS
SLQPDDFATYYC*FQGSGYPFT*FGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO:
755)

>XENCXXX human_IL12p40(E59K/K99Y/N200Q)_(GGGGS)5-human_IL12p35_(GGGGS)2_(single-chain)-
Numax_Fc(216)_IgG1_pI(-
)_Isosteric_A_C220S/PVA_/S267K/L368D/K370S/M428L/N434S_Fc(216)_IgG1_C220S/PVA_/S267K/S364K/E
357Q/M428L/N434S
Chain 1 - human_IL12p40(E59K/K99Y/N200Q)_(GGGGS)5-human_IL12p35_(GGGGS)2_(single-
chain)_Fc(216)_IgG1_pI(-)_Isosteric_A_C220S/PVA_/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQYEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/*GGGGSGGGGSGGGGSGGGGSGGGGS*/*RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 853)

Figure 112B

Chain 2 - Numax_VH_IgG1_C220S/PVA_/S267K/S364K/E357Q/M428L/N434S
QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVLHEALHSHYTQKSLSLSPGK
(SEQ ID NO: 759)

Chain 3 - Numax LC
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

>XENCXXX human_IL12p40(E59K/K99E/N200Q)_(GGGGS)5-human_IL12p35_(GGGGS)2_(single-chain)-Numax_Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S

Chain 1 - human_IL12p40(E59K/K99E/N200Q)_(GGGGS)5-human_IL12p35_(GGGGS)2_(single-chain)_Fc(216)_IgG1_pI(-)_Isosteric_A_C220S/PVA_/S267K/L368D/K370S/M428L/N434S
IEWLKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGSGGGGSGGGGSGGGGS/RNLPVATPDFGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 854)

Chain 2 - Numax_VH_IgG1_C220S/PVA_/S267K/S364K/E357Q/M428L/N434S
QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVLHEALHSHYTQKSLSLSPGK
(SEQ ID NO: 759)

Chain 3 - Numax LC
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

Figure 112C

\>XENCXXX human_IL12p40(D18K/E59K/K99E/N200Q)_(GGGGS)5-human_IL12p35_(GGGGS)2_(single-chain)-Numax_Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S

Chain 1 - human_IL12p40(D18K/E59K/K99E/N200Q)_(GGGGS)5-human_IL12p35_(GGGGS)2_(single-chain)_Fc(216)_IgG1_pI(-)_Isosteric_A_C220S/PVA_/S267K/L368D/K370S/M428L/N434S
IEWLKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/*GGGGSGGGGSGGGGSGGGGSGGGGS*/*RNLPVATPDPGMFPCLHHSQNLLRAVSNMLQKARQTLEFYPC*
*TSEEIDHEDITKDKTSTVEACLPLELTKNESCLNSRETSFITNGSCLASRKTSFMMALCLSSIYEDLKMYQVEFK*
*TMNAKLLMDPKRQIFLDQNMLAVIDELMQALNFNSETVPQKSSLEEPDFYKTKIKLCILLHAFRIRAVTIDRVMS*
*YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 855)

Chain 2 - Numax_VH_IgG1_C220S/PVA_/S267K/S364K/E357Q/M428L/N434S
QVTLRESGPALVKPTQTLTLTCTFSGFSLSTAGMSVGWIRQPPGKALEWLADIWDDKKRYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVLHEALHSHYTQKSLSLSPGK
(SEQ ID NO: 759)

Chain 3 - Numax LC
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

\>XENCXXX human_IL12p40(E59K/K99E/N200Q/K264E)_(GGGGS)5-human_IL12p35_(GGGGS)2_(single-chain)-Numax_Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S

Chain 1 - human_IL12p40(E59K/K99E/N200Q/K264E)_(GGGGS)5-human_IL12p35_(GGGGS)2_(single-chain)_Fc(216)_IgG1_pI(-)_Isosteric_A_C220S/PVA_/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKEDRVFTDKTSATVICRKNASISVRAQDRYYSSSWSEW
ASVPCS/*GGGGSGGGGSGGGGSGGGGSGGGGS*/*RNLPVATPDPGMFPCLHHSQNLLRAVSNMLQKARQTLEFYPC*
*TSEEIDHEDITKDKTSTVEACLPLELTKNESCLNSRETSFITNGSCLASRKTSFMMALCLSSIYEDLKMYQVEFK*
*TMNAKLLMDPKRQIFLDQNMLAVIDELMQALNFNSETVPQKSSLEEPDFYKTKIKLCILLHAFRIRAVTIDRVMS*
*YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 856)

Figure 112D

Chain 2 - Numax_VH_IgG1_C220S/PVA_/S267K/S364K/E357Q/M428L/N434S
QVTLRESGPALVKPTQTLTLTCTFSGFSLSTAGMSVGWIRQPPGKALEWLADIWWDDKKRYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVLHEALHSHYTQKSLSLSPGK
(SEQ ID NO: 759)

Chain 3 - Numax LC
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

<u>>XENP33691 human_IL12p40_D18K/E59K/K99E/N200Q/K264E_(GGGGS)5-
human_IL12p35_(GGGGS)2_(single-chain)-Numax_Fc(216)_IgG1_pI(-
)_Isosteric_A_C220S/PVA_/S267K/L368D/K370S/M428L/N434S-
IgG1_PVA_/S267K/S364K/E357Q/M428L/N434S</u>

Chain 1 - human_IL12p40_D18K/E59K/K99E/N200Q/K264E_(GGGGS)5-human_IL12p35_(GGGGS)2_(single-chain)_Fc(216)_IgG1_pI(-)_Isosteric_A_C220S/PVA_/S267K/L368D/K370S/M428L/N434S
IWELKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKEDRVFTDKTSATVICRKNASISVRAQDRYYSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 857)

Chain 2 - Numax_VH_IgG1_PVA_/S267K/S364K/E357Q/M428L/N434S
QVTLRESGPALVKPTQTLTLTCTFSGFSLSTAGMSVGWIRQPPGKALEWLADIWWDDKKRYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVLHEALHSHYTQKSLSLSPGK
(SEQ ID NO: 758)

Chain 3 - Numax LC
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

Figure 113A

RSV Targeted Xtend - Affinity Variants + C252S + N200Q

>XENCXXX human_I

Figure 113B

Chain 2 - Numax_VH_IgG1_C220S/PVA_/S267K/S364K/E357Q/M428L/N434S
QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVLHEALHSHYTQKSLSLSPGK
(SEQ ID NO: 759)

Chain 3 - Numax LC
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

>XENCXXX human_IL12p40(E59K/K99E/N200Q/C252S)_(GGGGS)5-human_IL12p35_(GGGGS)2_(single-chain)-Numax_Fc(216)_IgG1_pI(-)_Isosteric_A_C220S/PVA_/S267K/L368D/K370S/M428L/N434S_Fc(216)_IgG1_C220S/PVA_/S267K/S364K/E357Q/M428L/N434S

Chain 1 - human_IL12p40(E59K/K99E/N200Q/C252S)_(GGGGS)5-human_IL12p35_(GGGGS)2_(single-chain)_Fc(216)_IgG1_pI(-)_Isosteric_A_C220S/PVA_/S267K/L368D/K370S/M428L/N434S
IEWLKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGSGGGGSGGGGSGGGGS/RNLPVATPDFGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 860)

Chain 2 - Numax_VH_IgG1_C220S/PVA_/S267K/S364K/E357Q/M428L/N434S
QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVLHEALHSHYTQKSLSLSPGK
(SEQ ID NO: 759)

Chain 3 - Numax LC
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

Figure 113C

>XENCXXX_human_IL12p40(D18K/E59K/K99E/N200Q/C252S)_(GGGGS)5-human_IL12p35_(GGGGS)2_(single-chain)-Numax_Fc(216)_IgG1_pI(-
)_Isosteric_A_C220S/PVA_/S267K/L368D/K370S/M428L/N434S_Fc(216)_IgG1_C220S/PVA_/S267K/S364K/E357Q/M428L/N434S

Chain 1 - human_IL12p40(D18K/E59K/K99E/N200Q/C252S)_(GGGGS)5-human_IL12p35_(GGGGS)2_(single-chain)_Fc(216)_IgG1_pI(-)_Isosteric_A_C220S/PVA_/S267K/L368D/K370S/M428L/N434S
IEWLKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGSGGGGSGGGGSGGGGS/*RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS*/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 861)

Chain 2 - Numax_VH_IgG1_C220S/PVA_/S267K/S364K/E357Q/M428L/N434S
QVTLRESGPALVKPTQTLTLTCTFSGFSLSTAGMSVGWIRQPPGKALEWLADIWWDDKKYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVLHEALHSHYTQKSLSLSPGK
(SEQ ID NO: 759)

Chain 3 - Numax LC
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO: 755)

>XENCXXX_human_IL12p40(E59K/K99E/N200Q/C252S/K264E)_(GGGGS)5-
human_IL12p35_(GGGGS)2_(single-chain)-Numax_Fc(216)_IgG1_pI(-
)_Isosteric_A_C220S/PVA_/S267K/L368D/K370S/M428L/N434S_Fc(216)_IgG1_C220S/PVA_/S267K/S364K/E357Q/M428L/N434S

Chain 1 - human_IL12p40(E59K/K99E/N200Q/C252S/K264E)_(GGGGS)5-human_IL12p35_(GGGGS)2_(single-chain)_Fc(216)_IgG1_pI(-)_Isosteric_A_C220S/PVA_/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS/GGGGSGGGGSGGGGSGGGGSGGGGS/*RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS*/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 862)

Figure 113D

Chain 2 - Numax_VH_IgG1_C220S/PVA_/S267K/S364K/E357Q/M428L/N434S
QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVLHEALHSHYTQKSLSLSPGK
(SEQ ID NO: 759)

Chain 3 - Numax LC
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO:
755)

>XENP33692 human_IL12p40_D18K/E59K/K99E/N200Q/C252S/K264E_(GGGGS)5-
human_IL12p35_(GGGGS)2_(single-chain)-Numax_Fc(216)_IgG1_pI(-
)_Isosteric_A_C220S/PVA_/S267K/L368D/K370S/M428L/N434S-
IgG1_PVA_/S267K/S364K/E357Q/M428L/N434S

Chain 1 - human_IL12p40_D18K/E59K/K99E/N200Q/C252S/K264E_(GGGGS)5-
human_IL12p35_(GGGGS)2_(single-chain)_Fc(216)_IgG1_pI(-
)_Isosteric_A_C220S/PVA_/S267K/L368D/K370S/M428L/N434S
IWELKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKEDRVFTDKTSATVICRKNASISVPAQDRYYSSSWSEW
ASVPCS/GGGGSGGGGSGGGGSGGGGSGGGGS/RNLPVATDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 863)

Chain 2 - Numax_VH_IgG1_PVA_/S267K/S364K/E357Q/M428L/N434S
QVTLRESGPALVKPTQTLTLTCTFSGFSLSTAGMSVGWIRQPPGKALEWLADIWWDDKKHYNPSLKDRLTISKDT
SKNQVVLKVTNMDPADTATYYCARDMIFNFYFDVWGQGTTVTVSS/ASTKGPSVFPLAPSSKSTSGGTAALGCLV
KDYFPEPVTVSWNSGALTSGVHTFPAVLQSSGLYSLSSVVTVPSSSLGTQTYICNVNHKPSNTKVDKKVEPKSCD
KTHTCPPCPAPPVAGPSVFLFPPKPKDTLMISRTPEVTCVVVDVKHEDPEVKFNWYVDGVEVHNAKTKPREEQYN
STYRVVSVLTVLHQDWLNGKEYKCKVSNKALPAPIEKTISKAKGQPREPQVYTLPPSREQMTKNQVKLTCLVKGF
YPSDIAVEWESNGQPENNYKTTPPVLDSDGSFFLYSKLTVDKSRWQQGNVFSCSVLHEALHSHYTQKSLSLSPGK
(SEQ ID NO: 758)

Chain 3 - Numax LC
DIQMTQSPSTLSASVGDRVTITCSASSRVGYMHWYQQKPGKAPKLLIYDTSKLASGVPSRFSGSGSGTEFTLTIS
SLQPDDFATYYCFQGSGYPFTFGGGTKVEIK/RTVAAPSVFIFPPSDEQLKSGTASVVCLLNNFYPREAKVQWKV
DNALQSGNSQESVTEQDSKDSTYSLSSTLTLSKADYEKHKVYACEVTHQGLSSPVTKSFNRGEC (SEQ ID NO:
755)

Figure 114A

PD-L1 Targeted Non-Xtend - Affinity Variants

>XENCXXX_human_IL12p40(E59K)_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S-IgG1_PVA_/S267K/S364K/E357Q

Chain 1 - human_IL12p40(E59K)_(GGGGS)5-human_IL12p35_(GGGGS)2_(single-chain)_Fc(216)_IgG1_pI(-)_Isosteric_A_C220S/PVA_/S267K/L368D/K370S

IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/*GGGGSGGGGSGGGGSGGGGSGGGGS*/*RNLPVATDPGMFPCLHHSQNLLRAVSNMLQKARQTLEFYPC*
*TSEEIDHEDITKDKTSTVEACLPLELTKNESCLNSRETSFITNGSCLASRKTSFMMALCLSSIYEDLKMYQVEFK*
*TMNAKLLMDPKRQIFLDQNMLAVIDELMQALNFNSETVPQKSSLEEPDFYKTKIKLCILLHAFRIRAVTIDRVMS*
*YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK    (SEQ ID NO: 815)

Chain 2 - YW243.55.S70[PD-L1]_H0_IgG1_PVA_/S267K/S364K/E357Q

EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK
(SEQ ID NO: 751)

Chain 3 - YW243.55.S70[PD-L1]_L0

DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

>XENCXXX_human_IL12p40(D18K/E59K/K99E/K264E)_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S-IgG1_PVA_/S267K/S364K/E357Q

Chain 1 - human_IL12p40(D18K/E59K/K99E/K264E)_(GGGGS)5-human_IL12p35_(GGGGS)2_(single-chain)_Fc(216)_IgG1_pI(-)_Isosteric_A_C220S/PVA_/S267K/L368D/K370S

IEWLKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKEDRVFTDKTSATVICRKNASISVRAQDRYYSSSWSEW
ASVPCS/*GGGGSGGGGSGGGGSGGGGSGGGGS*/*RNLPVATDPGMFPCLHHSQNLLRAVSNMLQKARQTLEFYPC*
*TSEEIDHEDITKDKTSTVEACLPLELTKNESCLNSRETSFITNGSCLASRKTSFMMALCLSSIYEDLKMYQVEFK*
*TMNAKLLMDPKRQIFLDQNMLAVIDELMQALNFNSETVPQKSSLEEPDFYKTKIKLCILLHAFRIRAVTIDRVMS*
*YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK    (SEQ ID NO: 890)

Figure 114B

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK
(SEQ ID NO: 751)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

Figure 115A

PD-L1 Targeted Non-Xtend - Affinity Variants + C252S

>XENCXXX human_IL12p40(E59K/C252S)_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S-IgG1_PVA_/S267K/S364K/E357Q Chain 1 - human_IL12p40(E59K/C252S)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/*GGGGSGGGGSGGGGSGGGGSGGGGS*/*RNLPVATPDPGMFPCLHHSQNLLRAVSNMLQKARQTLEFYPC*
*TSEEIDHEDITKDKTSTVEACLPLELTKNESCLNSRETSFITNGSCLASRKTSFMMALCLSSIYEDLKMYQVEFK*
*TMNAKLLMDPKRQIFLDQNMLAVIDELMQALNFNSETVPQKSSLEEPDFYKTKIKLCILLHAFRIRAVTIDRVMS*
*YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 819)

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK
(SEQ ID NO: 751)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

>XENCXXX human_IL12p40(E59K/K99Y/C252S)_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S-IgG1_PVA_/S267K/S364K/E357Q Chain 1 - human_IL12p40(E59K/K99Y/C252S)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQYEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/*GGGGSGGGGSGGGGSGGGGSGGGGS*/*RNLPVATPDPGMFPCLHHSQNLLRAVSNMLQKARQTLEFYPC*
*TSEEIDHEDITKDKTSTVEACLPLELTKNESCLNSRETSFITNGSCLASRKTSFMMALCLSSIYEDLKMYQVEFK*
*TMNAKLLMDPKRQIFLDQNMLAVIDELMQALNFNSETVPQKSSLEEPDFYKTKIKLCILLHAFRIRAVTIDRVMS*
*YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 820)

Figure 115B

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK
(SEQ ID NO: 751)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

>XENCXXX human_IL12p40(E59K/K99E/C252S)_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S-IgG1_PVA_/S267K/S364K/E357Q

Chain 1 - human_IL12p40(E59K/K99E/C252S)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 821)

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK
(SEQ ID NO: 751)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

Figure 115C

>XENCXXX_human_IL12p40(D18K/E59K/K99E/C252S)_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S-IgG1_PVA_/S267K/S364K/E357Q

Chain 1 - human_IL12p40(D18K/E59K/K99E/C252S)_(GGGGS)5-human_IL12p35_(GGGGS)2_(single-chain)_Fc(216)_IgG1_pI(-)_Isosteric_A_C220S/PVA_/S267K/L368D/K370S

IEWLKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 894)

Chain 2 - YW243.55.S70[PD-L1]_H0_IgG1_PVA_/S267K/S364K/E357Q

EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK
(SEQ ID NO: 751)

Chain 3 - YW243.55.S70[PD-L1]_L0

DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

>XENCXXX_human_IL12p40(E59K/K99E/C252S/K264E)_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S-IgG1_PVA_/S267K/S364K/E357Q

Chain 1 - human_IL12p40(E59K/K99E/C252S/K264E)_(GGGGS)5-human_IL12p35_(GGGGS)2_(single-chain)_Fc(216)_IgG1_pI(-)_Isosteric_A_C220S/PVA_/S267K/L368D/K370S

IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 895)

Figure 115D

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK
(SEQ ID NO: 751)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

>XENCXXX human_IL12p40(D18K/E59K/K99E/C252S/K264E)_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S-IgG1_PVA_/S267K/S364K/E357Q

Chain 1 - human_IL12p40(D18K/E59K/K99E/C252S/K264E)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPKAPGEMVVLTCDTPEEDGITWTLDQSSEVLGSGKTLTIQVKEFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 896)

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK
(SEQ ID NO: 751)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

Figure 116A

PD-L1 Targeted Non-Xtend - Affinity Variants + N200Q

>XENCXXX human_IL12p40(E59K/N200Q)_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S-IgG1_PVA_/S267K/S364K/E357Q

Chain 1 - human_IL12p40(E59K/N200Q)_(GGGGS)5-human_IL12p35_(GGGGS)2_(single-chain)_Fc(216)_IgG1_pI(-)_Isosteric_A_C220S/PVA_/S267K/L368D/K370S

IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/*GGGGSGGGGSGGGGSGGGGSGGGGS*/*RNLPVATDPGMFPCLHHSQNLLRAVSNMLQKARQTLEFYPC*
*TSEEIDHEDITKDKTSTVEACLPLELTKNESCLNSRETSFITNGSCLASRKTSFMMALCLSSIYEDLKMYQVEFK*
*TMNAKLLMDPKRQIFLDQNMLAVIDELMQALNFNSETVPQKSSLEEPDFYKTKIKLCILLHAFRIRAVTIDRVMS*
*YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK    (SEQ ID NO: 822)

Chain 2 - YW243.55.S70[PD-L1]_H0_IgG1_PVA_/S267K/S364K/E357Q

EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK
(SEQ ID NO: 751)

Chain 3 - YW243.55.S70[PD-L1]_L0

DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

>XENCXXX human_IL12p40(E59K/K99Y/N200Q)_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S-IgG1_PVA_/S267K/S364K/E357Q

Chain 1 - human_IL12p40(E59K/K99Y/N200Q)_(GGGGS)5-human_IL12p35_(GGGGS)2_(single-chain)_Fc(216)_IgG1_pI(-)_Isosteric_A_C220S/PVA_/S267K/L368D/K370S

IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQYEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/*GGGGSGGGGSGGGGSGGGGSGGGGS*/*RNLPVATDPGMFPCLHHSQNLLRAVSNMLQKARQTLEFYPC*
*TSEEIDHEDITKDKTSTVEACLPLELTKNESCLNSRETSFITNGSCLASRKTSFMMALCLSSIYEDLKMYQVEFK*
*TMNAKLLMDPKRQIFLDQNMLAVIDELMQALNFNSETVPQKSSLEEPDFYKTKIKLCILLHAFRIRAVTIDRVMS*
*YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK    (SEQ ID NO: 823)

Figure 116B

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK
(SEQ ID NO: 751)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

>XENCXXX human_IL12p40(E59K/K99E/N200Q)_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S-IgG1_PVA_/S267K/S364K/E357Q

Chain 1 - human_IL12p40(E59K/K99E/N200Q)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGSGGGGSGGGGSGGGGS/*RNLPVATPDPGMFPCLHHSQNLLRAVSNMLQKARQTLEFYPC
TSEEIDHEDITKDRTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS*/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 824)

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK
(SEQ ID NO: 751)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

Figure 116C

>XENCXXX human_IL12p40(D18K/E59K/K99E/N200Q)_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S-IgG1_PVA_/S267K/S364K/E357Q Chain 1 - human_IL12p40(D18K/E59K/K99E/N200Q)_(GGGGS)5-human_IL12p35_(GGGGS)2_(single-chain)_Fc(216)_IgG1_pI(-)_Isosteric_A_C220S/PVA_/S267K/L368D/K370S IEWLKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/*GGGGSGGGGSGGGGSGGGGSGGGGS*/RNLPVATPDPGMFPCLHHSQNLLRAVSNMLQKARQTLEFYPC
*TSEEIDHEDITKDKTSTVEACLPLELTKNESCLNSRETSFITNGSCLASRKTSFMMALCLSSIYEDLKMYQVEFK*
*TMNAKLLMDPKRQIFLDQNMLAVIDELMQALNFNSETVPQKSSLEEPDFYKTKIKLCILLHAFRIRAVTIDRVMS*
*YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK   (SEQ ID NO: 825)

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNRYTQKSLSLSPGK
(SEQ ID NO: 751)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC   (SEQ ID NO: 752)

>XENCXXX human_IL12p40(E59K/K99E/N200Q/K264E)_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S-IgG1_PVA_/S267K/S364K/E357Q Chain 1 - human_IL12p40(E59K/K99E/N200Q/K264E)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKEDRVFTDKTSATVICRKNASISVRAQDRYYSSSWSEW
ASVPCS/*GGGGSGGGGSGGGGSGGGGSGGGGS*/RNLPVATPDPGMFPCLHHSQNLLRAVSNMLQKARQTLEFYPC
*TSEEIDHEDITKDKTSTVEACLPLELTKNESCLNSRETSFITNGSCLASRKTSFMMALCLSSIYEDLKMYQVEFK*
*TMNAKLLMDPKRQIFLDQNMLAVIDELMQALNFNSETVPQKSSLEEPDFYKTKIKLCILLHAFRIRAVTIDRVMS*
*YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK   (SEQ ID NO: 826)

Figure 116D

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK
(SEQ ID NO: 751)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

>XENCXXX human_IL12p40(D18K/E59K/K99E/N200Q/K264E)_(GGGGS)5-human_IL12p35_(GGGGS)2_(single-chain)-YW243.55.S70[PD-L1]_H0L0_Fc(216)_IgG1_pl(-)_Isosteric_A_C220S/PVA_/S267K/L368D/K370S-IgG1_PVA_/S267K/S364K/E357Q

Chain 1 - human_IL12p40(D18K/E59K/K99E/N200Q/K264E)_(GGGGS)5-human_IL12p35_(GGGGS)2_(single-chain)_Fc(216)_IgG1_pl(-)_Isosteric_A_C220S/PVA_/S267K/L368D/K370S
IEWLKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKEDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 872)

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK
(SEQ ID NO: 751)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

Figure 117A

PD-L1 Targeted Non-Xtend - Affinity Variants + C252S + N200Q

>XENCXXX human_IL12p40(E59K/N200Q/C252S)_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S-IgG1_PVA_/S267K/S364K/E357Q

Chain 1 - human_IL12p40(E59K/N200Q/C252S)_(GGGGS)5-human_IL12p35_(GGGGS)2_(single-chain)_Fc(216)_IgG1_pI(-)_Isosteric_A_C220S/PVA_/S267K/L368D/K370S

IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 830)

Chain 2 - YW243.55.S70[PD-L1]_H0_IgG1_PVA_/S267K/S364K/E357Q

EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK
(SEQ ID NO: 751)

Chain 3 - YW243.55.S70[PD-L1]_L0

DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

>XENCXXX human_IL12p40(E59K/K99Y/N200Q/C252S)_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S-IgG1_PVA_/S267K/S364K/E357Q

Chain 1 - human_IL12p40(E59K/K99Y/N200Q/C252S)_(GGGGS)5-human_IL12p35_(GGGGS)2_(single-chain)_Fc(216)_IgG1_pI(-)_Isosteric_A_C220S/PVA_/S267K/L368D/K370S

IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQYEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 831)

Figure 117B

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK
(SEQ ID NO: 751)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

>XENCXXX human_IL12p40(E59K/K99E/N200Q/C252S)_(GGGGS)5-human_IL12p35_(GGGGS)2_(single-chain)-YW243.55.S70[PD-L1]_HOLO_Fc(216)_IgG1_pI(-)_Isosteric_A_C220S/PVA_/S267K/L368D/K370S-IgG1_PVA_/S267K/S364K/E357Q

Chain 1 - human_IL12p40(E59K/K99E/N200Q/C252S)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 832)

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK
(SEQ ID NO: 751)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

Figure 117C

>XENCXXX human_IL12p40(D18K/E59K/K99E/N200Q/C252S)_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S-IgG1_PVA_/S267K/S364K/E357Q

Chain 1 - human_IL12p40(D18K/E59K/K99E/N200Q/C252S)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/*GGGGSGGGGSGGGGSGGGGSGGGGS*/*RNLPVATPDPGMFPCLHHSQNLLRAVSNMLQKARQTLEFYPC*
*TSEEIDHEDITKDKTSTVEACLPLELTKNESCLNSRETSFITNGSCLASRKTSFMMALCLSSIYEDLKMYQVEFK*
*TMNAKLLMDPKRQIFLDQNMLAVIDELMQALNFNSETVPQKSSLEEPDFYKTKIKLCILLHAFRIRAVTIDRVMS*
*YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK   (SEQ ID NO: 834)

Chain 2 - YW243.55.S70[PD-L1]_H0_IgG1_PVA_/S267K/S364K/E357Q
EVQLVESGGGLVQPGGSLRLSCAASGFTFS<u>DSWI</u>HWVRQAPGKGLEWVA<u>WISPYGGSTYYADSVKG</u>RFTISADTS
KNTAYLQMNSLRAEDTAVYYCARR<u>HWPGGFDY</u>WGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK
(SEQ ID NO: 751)

Chain 3 - YW243.55.S70[PD-L1]_L0
DIQMTQSPSSLSASVGDRVTITC<u>RASQDVSTAVA</u>WYQQKPGKAPKLLIY<u>SASFLY</u>SGVPSRFSGSGSGTDFTLTI
SSLQPEDFATYYC<u>QQYLYHPAT</u>FGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

>XENCXXX human_IL12p40(E59K/K99E/N200Q/C252S/K264E)_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S-IgG1_PVA_/S267K/S364K/E357Q

Chain 1 - human_IL12p40(E59K/K99E/N200Q/C252S/K264E)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS/<u>GGGGSGGGGSGGGGSGGGGSGGGGS</u>/*RNLPVATPDPGMFPCLHHSQNLLRAVSNMLQKARQTLEFYPC*
*TSEEIDHEDITKDKTSTVEACLPLELTKNESCLNSRETSFITNGSCLASRKTSFMMALCLSSIYEDLKMYQVEFK*
*TMNAKLLMDPKRQIFLDQNMLAVIDELMQALNFNSETVPQKSSLEEPDFYKTKIKLCILLHAFRIRAVTIDRVMS*
*YLNAS*/<u>GGGGSGGGGS</u>/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK   (SEQ ID NO: 835)

Figure 117D

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK
(SEQ ID NO: 751)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

>XENCXXX human_IL12p40(D18K/E59K/K99E/N200Q/C252S/K264E)_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S-IgG1_PVA_/S267K/S364K/E357Q

Chain 1 - human_IL12p40(D18K/E59K/K99E/N200Q/C252S/K264E)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPKAPGEMVVLTCDTPEEDGITWTLDQSSEVLGSGKTLTIQVKEFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS/GGGGSGGGGSGGGGSGGGGSGGGGS/RNLPVATPDFGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVMHEALHNHYTQKSLSLSPGK (SEQ ID NO: 873)

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVMHEALHNHYTQKSLSLSPGK
(SEQ ID NO: 751)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

Figure 118A

PD-L1 Targeted Xtend - Affinity Variants

>XENCXXX human_IL12p40(E59K)_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S/M428L/N434S -
IgG1_PVA_/S267K/S364K/E357Q/M428L/N434S Chain 1 - human_IL12p40(E59K)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGSGGGGSGGGGSGGGGS/*RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS*/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 874)

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK
(SEQ ID NO: 869)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

>XENCXXX human_IL12p40(E59K/K99Y)_(GGGGS)5-human_IL12p35_(GGGGS)2_(single-chain)-
YW243.55.S70[PD-L1]_H0L0_Fc(216)_IgG1_pI(-)_Isosteric_A_C220S/PVA_/S267K/L368D/K370S/M428L/N434S -
IgG1_PVA_/S267K/S364K/E357Q/M428L/N434S Chain 1 - human_IL12p40(E59K/K99Y)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQYEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGSGGGGSGGGGSGGGGS/*RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS*/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 875)

Figure 118B

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK
(SEQ ID NO: 869)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID
NO: 752)

>XENCXXX human_IL12p40(E59K/K99E)_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S/M428L/N434S - IgG1_PVA_/S267K/S364K/E357Q/M428L/N434S

Chain 1 - human_IL12p40(E59K/K99E)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/*GGGGSGGGGSGGGGSGGGGSGGGGS*/*RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS*/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK   (SEQ ID NO: 876)

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK
(SEQ ID NO: 869)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO:
752)

Figure 118C

>XENCXXX_human_IL12p40(D18K/E59K/K99E)_(GGGGS)5-human_IL12p35_(GGGGS)2_(single-chain)-
YW243.55.S70[PD-L1]_H0L0_Fc(216)_IgG1_pI(-
)_Isosteric_A_C220S/PVA_/S267K/L368D/K370S/M428L/N434S_-
IgG1_PVA_/S267K/S364K/E357Q/M428L/N434S

Chain 1 - human_IL12p40(D18K/E59K/K99E)_(GGGGS)5-human_IL12p35_(GGGGS)2_(single-chain)_Fc(216)_IgG1_pI(-)_Isosteric_A_C220S/PVA_/S267K/L368D/K370S

IEWLKKDVYVVELDWYP<u>K</u>APGEMVVLTCDTPEEDGITWTLDQSSEVLGSGKTLTIQVK<u>K</u>FGDAGQYTCHKGGEVL
SHSLLLLHKKEDGIWSTDILKDQ<u>E</u>EPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSWSEW
ASVPCS/*GGGGSGGGGSGGGGSGGGGSGGGGS*/*RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK    (SEQ ID NO: 877)

Chain 2 - YW243.55.S70[PD-L1]_H0_IgG1_PVA_/S267K/S364K/E357Q

EVQLVESGGGLVQPGGSLRLSCAASGFTFS<u>DSWIH</u>WVRQAPGKGLEWVA<u>WISPYGGSTYYADSVK</u>GRFTISADTS
KNTAYLQMNSLRAEDTAVYYCARR<u>HWPGGFDY</u>WGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK
(SEQ ID NO: 869)

Chain 3 - YW243.55.S70[PD-L1]_L0

DIQMTQSPSSLSASVGDRVTITC<u>RASQDVSTAVA</u>WYQQKPGKAPKLLIY<u>SASFLYS</u>GVPSRFSGSGSGTDFTLTI
SSLQPEDFATYYC<u>QQYLYHPAT</u>FGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

>XENCXXX_human_IL12p40(E59K/K99E/K264E)_(GGGGS)5-human_IL12p35_(GGGGS)2_(single-chain)-
YW243.55.S70[PD-L1]_H0L0_Fc(216)_IgG1_pI(-
)_Isosteric_A_C220S/PVA_/S267K/L368D/K370S/M428L/N434S_-
IgG1_PVA_/S267K/S364K/E357Q/M428L/N434S

Chain 1 - human_IL12p40(E59K/K99E/K264E)_(GGGGS)5-human_IL12p35_(GGGGS)2_(single-chain)_Fc(216)_IgG1_pI(-)_Isosteric_A_C220S/PVA_/S267K/L368D/K370S

IEWLKKDVYVVELDWYPDAPGEMVVLTCDTPEEDGITWTLDQSSEVLGSGKTLTIQVK<u>K</u>FGDAGQYTCHKGGEVL
SHSLLLLHKKEDGIWSTDILKDQ<u>E</u>EPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREK<u>E</u>DRVFTDKTSATVICRKNASISVRAQDRYYSSWSEW
ASVPCS/*GGGGSGGGGSGGGGSGGGGSGGGGS*/*RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK    (SEQ ID NO: 878)

Figure 118D

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK
(SEQ ID NO: 869)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

>XENCXXX human_IL12p40(D18K/E59K/K99E/K264E)_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S/M428L/N434S - IgG1_PVA_/S267K/S364K/E357Q/M428L/N434S

Chain 1 - human_IL12p40(D18K/E59K/K99E/K264E)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFCVQVQGKSKREKEDRVFTDKTSATVICRKNASISVRAQDRYYSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 879)

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK
(SEQ ID NO: 869)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

Figure 119A

PD-L1 Targeted Xtend - Affinity Variants + C252S

>XENCXXX_human_IL12p40(E59K/C252S)_(GGGGS)5-human_IL12p35_(GGGGS)2_(single-chain)-
YW243.55.S70[PD-L1]_H0L0_Fc(216)_IgG1_pI(-
)_Isosteric_A_C220S/PVA_/S267K/L368D/K370S/M428L/N434S -
IgG1_PVA_/S267K/S364K/E357Q/M428L/N434S

Chain 1 - human_IL12p40(E59K/C252S)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/*GGGGSGGGGSGGGGSGGGGSGGGGS*/*RNLPVATPDPGMFPCLHHSQNLLRAVSNMLQKARQTLEFYPC*
*TSEEIDHEDITKDKTSTVEACLPLELTKNESCLNSRETSFITNGSCLASRKTSFMMALCLSSIYEDLKMYQVEFK*
*TMNAKLLMDPKRQIFLDQNMLAVIDELMQALNFNSETVPQKSSLEEPDFYKTKIKLCILLHAFRIRAVTIDRVMS*
*YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK   (SEQ ID NO: 880)

Chain 2 - YW243.55.S70[PD-L1]_H0_IgG1_PVA_/S267K/S364K/E357Q
EVQLVESGGGLVQPGGSLRLSCAASGFTFS<u>DSWIHW</u>VRQAPGKGLEWVA<u>WISPYGGSTYYADSVK</u>GRFTISADTS
KNTAYLQMNSLRAEDTAVYYCARR<u>HWPGGFDY</u>WGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK
(SEQ ID NO: 869)

Chain 3 - YW243.55.S70[PD-L1]_L0
DIQMTQSPSSLSASVGDRVTITC<u>RASQDVSTAVA</u>WYQQKPGKAPKLLIY<u>SASFLY</u>SGVPSRFSGSGSGTDFTLTI
SSLQPEDFATYYC<u>QQYLYHPAT</u>FGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO:
752)

>XENCXXX_human_IL12p40(E59K/K99Y/C252S)_(GGGGS)5-human_IL12p35_(GGGGS)2_(single-chain)-
YW243.55.S70[PD-L1]_H0L0_Fc(216)_IgG1_pI(-
)_Isosteric_A_C220S/PVA_/S267K/L368D/K370S/M428L/N434S -
IgG1_PVA_/S267K/S364K/E357Q/M428L/N434S

Chain 1 - human_IL12p40(E59K/K99Y/C252S)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQYEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/*GGGGSGGGGSGGGGSGGGGSGGGGS*/*RNLPVATPDPGMFPCLHHSQNLLRAVSNMLQKARQTLEFYPC*
*TSEEIDHEDITKDKTSTVEACLPLELTKNESCLNSRETSFITNGSCLASRKTSFMMALCLSSIYEDLKMYQVEFK*
*TMNAKLLMDPKRQIFLDQNMLAVIDELMQALNFNSETVPQKSSLEEPDFYKTKIKLCILLHAFRIRAVTIDRVMS*
*YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK   (SEQ ID NO: 881)

Figure 119B

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK
(SEQ ID NO: 869)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

>XENCXXX human_IL12p40(E59K/K99E/C252S)_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S/M428L/N434S - IgG1_PVA_/S267K/S364K/E357Q/M428L/N434S

Chain 1 - human_IL12p40(E59K/K99E/C252S)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 882)

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK
(SEQ ID NO: 869)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

Figure 119C

>XENCXXX human_IL12p40(D18K/E59K/K99E/C252S)_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S/M428L/N434S - IgG1_PVA_/S267K/S364K/E357Q/M428L/N434S

Chain 1 - human_IL12p40(D18K/E59K/K99E/C252S)_(GGGGS)5-human_IL12p35_(GGGGS)2_(single-chain)_Fc(216)_IgG1_pI(-)_Isosteric_A_C220S/PVA_/S267K/L368D/K370S

IEWLKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 883)

Chain 2 - YW243.55.S70[PD-L1]_H0_IgG1_PVA_/S267K/S364K/E357Q

EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK
(SEQ ID NO: 869)

Chain 3 - YW243.55.S70[PD-L1]_L0

DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

>XENCXXX human_IL12p40(E59K/K99E/C252S/K264E)_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S/M428L/N434S - IgG1_PVA_/S267K/S364K/E357Q/M428L/N434S

Chain 1 - human_IL12p40(E59K/K99E/C252S/K264E)_(GGGGS)5-human_IL12p35_(GGGGS)2_(single-chain)_Fc(216)_IgG1_pI(-)_Isosteric_A_C220S/PVA_/S267K/L368D/K370S

IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 884)

Figure 119D

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK
(SEQ ID NO: 869)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

>XENCXXX human_IL12p40(D18K/E59K/K99E/C252S/K264E)_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S/M428L/N434S - IgG1_PVA_/S267K/S364K/E357Q/M428L/N434S

Chain 1 - human_IL12p40(D18K/E59K/K99E/C252S/K264E)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPKAPGEMVVLTCDTPEEDGITWTLDQSSEVLGSGKTLTIQVKEFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYENYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS/GGGGSGGGGSGGGGSGGGGSGGGGS/RNLPVATPDFGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 885)

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK
(SEQ ID NO: 869)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

Figure 120A

PD-L1 Targeted Xtend - Affinity Variants + N200Q

>XENCXXX_human_IL12p40(E59K/N200Q)_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S/M428L/N434S - IgG1_PVA_/S267K/S364K/E357Q/M428L/N434S

Chain 1 - human_IL12p40(E59K/N200Q)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/*GGGGSGGGGSGGGGSGGGGSGGGGS*/*RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 886)

Chain 2 - YW243.55.S70[PD-L1]_H0_IgG1_PVA_/S267K/S364K/E357Q
EVQLVESGGGLVQPGGSLRLSCAASGFTFS<u>DSWIH</u>WVRQAPGKGLEWVAW<u>ISPYGGSTYYADSVKG</u>RFTISADTS
KNTAYLQMNSLRAEDTAVYYCARR<u>HWPGGFDY</u>WGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK
(SEQ ID NO: 869)

Chain 3 - YW243.55.S70[PD-L1]_L0
DIQMTQSPSSLSASVGDRVTITC<u>RASQDVSTAVA</u>WYQQKPGKAPKLLIY<u>SASFLYS</u>GVPSRFSGSGSGTDFTLTI
SSLQPEDFATYYC<u>QQYLYHPAT</u>FGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

>XENCXXX_human_IL12p40(E59K/K99Y/N200Q)_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S/M428L/N434S - IgG1_PVA_/S267K/S364K/E357Q/M428L/N434S

Chain 1 - human_IL12p40(E59K/K99Y/N200Q)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQYEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/*GGGGSGGGGSGGGGSGGGGSGGGGS*/*RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 887)

Figure 120B

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK
(SEQ ID NO: 869)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

>XENCXXX human_IL12p40(E59K/K99E/N200Q)_(GGGGS)5-human_IL12p35_(GGGGS)2_(single-chain)-
YW243.55.S70[PD-L1]_H0L0_Fc(216)_IgG1_pI(-
)_Isosteric_A_C220S/PVA_/S267K/L368D/K370S/M428L/N434S -
IgG1_PVA_/S267K/S364K/E357Q/M428L/N434S

Chain 1 - human_IL12p40(E59K/K99E/N200Q)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 888)

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK
(SEQ ID NO: 869)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

Figure 120C

>XENCXXX_human_IL12p40(D18K/E59K/K99E/N200Q)_(GGGGS)5-human_IL12p35_(GGGGS)2_(single-chain)-YW243.55.S70[PD-L1]_H0L0_Fc(216)_IgG1_pl(-)_Isosteric_A_C220S/PVA_/S267K/L368D/K370S/M428L/N434S -
IgG1_PVA_/S267K/S364K/E357Q/M428L/N434S

Chain 1 - human_IL12p40(D18K/E59K/K99E/N200Q)_(GGGGS)5-human_IL12p35_(GGGGS)2_(single-chain)_Fc(216)_IgG1_pl(-)_Isosteric_A_C220S/PVA_/S267K/L368D/K370S
IEWLKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKKDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK   (SEQ ID NO: 889)

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK
(SEQ ID NO: 869)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

>XENCXXX_human_IL12p40(E59K/K99E/N200Q/K264E)_(GGGGS)5-human_IL12p35_(GGGGS)2_(single-chain)-YW243.55.S70[PD-L1]_H0L0_Fc(216)_IgG1_pl(-)_Isosteric_A_C220S/PVA_/S267K/L368D/K370S/M428L/N434S -
IgG1_PVA_/S267K/S364K/E357Q/M428L/N434S

Chain 1 - human_IL12p40(E59K/K99E/N200Q/K264E)_(GGGGS)5-human_IL12p35_(GGGGS)2_(single-chain)_Fc(216)_IgG1_pl(-)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKEDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK   (SEQ ID NO: 891)

Figure 120D

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK
(SEQ ID NO: 869)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

>XENCXXX human_IL12p40(D18K/E59K/K99E/N200Q/K264E)_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S/M428L/N434S - IgG1_PVA_/S267K/S364K/E357Q/M428L/N434S

Chain 1 - human_IL12p40(D18K/E59K/K99E/N200Q/K264E)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFCVQVQGKSKREKEDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 892)

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK
(SEQ ID NO: 869)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

Figure 121A

PD-L1 Targeted Xtend - Affinity Variants + C252S + N200Q

>XENCXXX human_IL12p40(E59K/N200Q/C252S)_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S/M428L/N434S - IgG1_PVA_/S267K/S364K/E357Q/M428L/N434S Chain 1 - human_IL12p40(E59K/N200Q/C252S)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQKEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK    (SEQ ID NO: 893)

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK
(SEQ ID NO: 869)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

>XENCXXX human_IL12p40(E59K/K99Y/N200Q/C252S)_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S/M428L/N434S - IgG1_PVA_/S267K/S364K/E357Q/M428L/N434S Chain 1 - human_IL12p40(E59K/K99Y/N200Q/C252S)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQYEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK    (SEQ ID NO: 897)

Figure 121B

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK
(SEQ ID NO: 869)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

>XENCXXX human_IL12p40(E59K/K99E/N200Q/C252S)_(GGGGS)5-human_IL12p35_(GGGGS)2_(single-chain)-YW243.55.S70[PD-L1]_H0L0_Fc(216)_IgG1_pl(-)_Isosteric_A_C220S/PVA_/S267K/L368D/K370S/M428L/N434S - IgG1_PVA_/S267K/S364K/E357Q/M428L/N434S

Chain 1 - human_IL12p40(E59K/K99E/N200Q/C252S)_(GGGGS)5-human_IL12p35_(GGGGS)2_(single-chain)_Fc(216)_IgG1_pl(-)_Isosteric_A_C220S/PVA_/S267K/L368D/K370S
IEWLKKDVYVVELDWYPDAPGEMVVLTCDTPEEDGITWTLDQSSEVLGSGKTLTIQVKEFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/GGGGSGGGGSGGGGSGGGGSGGGGS/RNLPVATPDFGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 898)

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK
(SEQ ID NO: 869)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

Figure 121C

>XENCXXX human_IL12p40(D18K/E59K/K99E/N200Q/C252S)_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S/M428L/N434S-IgG1_PVA_/S267K/S364K/E357Q/M428L/N434S

Chain 1 - human_IL12p40(D18K/E59K/K99E/N200Q/C252S)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPKAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKKDRVFTDKTSATVICRKNASISVRAQDRYYSSSWSEW
ASVPCS/*GGGGSGGGGSGGGGSGGGGSGGGGS*/*RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 866)

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK
(SEQ ID NO: 869)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 752)

>XENCXXX human_IL12p40(E59K/K99E/N200Q/C252S/K264E)_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S/M428L/N434S-IgG1_PVA_/S267K/S364K/E357Q/M428L/N434S

Chain 1 - human_IL12p40(E59K/K99E/N200Q/C252S/K264E)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS/*GGGGSGGGGSGGGGSGGGGSGGGGS*/*RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS*/*GGGGSGGGGS*/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 868)

Figure 121D

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK
(SEQ ID NO: 869)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 867)

>XENCXXX human_IL12p40(D18K/E59K/K99E/N200Q/C252S/K264E)_(GGGGS)5-human_IL12p35_(GGGGS)2_(single-chain)-YW243.55.S70[PD-L1]_H0L0_Fc(216)_IgG1_pI(-)_Isosteric_A_C220S/PVA_/S267K/L368D/K370S/M428L/N434S - IgG1_PVA_/S267K/S364K/E357Q/M428L/N434S

Chain 1 - human_IL12p40(D18K/E59K/K99E/N200Q/C252S/K264E)_(GGGGS)5-human_IL12p35_(GGGGS)2_(single-chain)_Fc(216)_IgG1_pI(-)_Isosteric_A_C220S/PVA_/S267K/L368D/K370S
IEWLKKDVYVVELDWYPKAPGEMVVLTCDTPEEDGITWTLDQSSEVLGSGKTLTIQVKEFGDAGQYTCHKGGEVL
SHSLLLLHKKEDGIWSTDILKDQEEPKNKTFLRCEAKNYSGRFTCWWLTTISTDLTFSVKSSRGSSDPQGVTCGA
ATLSAERVRGDNKEYEYSVECQEDSACPAAEESLPIEVMVDAVHKLKYEQYTSSFFIRDIIKPDPPKNLQLKPLK
NSRQVEVSWEYPDTWSTPHSYFSLTFSVQVQGKSKREKEDRVFTDKTSATVICRKNASISVRAQDRYYSSSWSEW
ASVPCS/GGGGSGGGGSGGGGSGGGGSGGGGS/RNLPVATPDPGMFPCLHHSQNLLRAVSNMLQKARQTLEFYPC
TSEEIDHEDITKDKTSTVEACLPLELTKNESCLNSRETSFITNGSCLASRKTSFMMALCLSSIYEDLKMYQVEFK
TMNAKLLMDPKRQIFLDQNMLAVIDELMQALNFNSETVPQKSSLEEPDFYKTKIKLCILLHAFRIRAVTIDRVMS
YLNAS/GGGGSGGGGS/EPKSSDKTHTCPPCPAPPVAGPSVFLFPPKPKDTLMISRTPEVTCVVVDVKHEDPEVK
FNWYVDGVEVHNAKTKPREEEYNSTYRVVSVLTVLHQDWLNGKEYKCKVSNKALPAPIEKTISKAKGQPREPQVY
TLPPSREEMTKNQVSLTCDVSGFYPSDIAVEWESDGQPENNYKTTPPVLDSDGSFFLYSKLTVDKSRWEQGDVFS
CSVLHEALHSHYTQKSLSLSPGK (SEQ ID NO: 873)

Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTS
KNTAYLQMNSLRAEDTAVYYCARRHWPGGFDYWGQGTLVTVSS/ASTKGPSVFPLAPSSKSTSGGTAALGCLVKD
YFPEPVTVSWNSGALTSGVHTFPAVLQSSGLYSLSSVVTVPSSSLGTQTYICNVNHKPSNTKVDKKVEPKSCDKT
HTCPPCPAPPVAGPSVFLFPPKPKDTLMISRTPEVTCVVVDVKHEDPEVKFNWYVDGVEVHNAKTKPREEQYNST
YRVVSVLTVLHQDWLNGKEYKCKVSNKALPAPIEKTISKAKGQPREPQVYTLPPSREQMTKNQVKLTCLVKGFYP
SDIAVEWESNGQPENNYKTTPPVLDSDGSFFLYSKLTVDKSRWQQGNVFSCSVLHEALHSHYTQKSLSLSPGK
(SEQ ID NO: 869)

Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTI
SSLQPEDFATYYCQQYLYHPATFGQGTKVEIK/RTVAAPSVFIFPPSDEQLKSGTASVVCLLNNFYPREAKVQWK
VDNALQSGNSQESVTEQDSKDSTYSLSSTLTLSKADYEKHKVYACEVTHQGLSSPVTKSFNRGEC (SEQ ID NO: 871)

TARGETED IL-12 HETERODIMERIC FC-FUSION PROTEINS

CROSS-REFERENCE TO RELATED APPLICATIONS

The application claims the benefit of U.S. Provisional Application No. 62/910,328 filed Oct. 3, 2019 and U.S. Provisional Application No. 63/005,100 filed Apr. 3, 2020, the contents of which are herein incorporated by reference in their entireties.

SEQUENCE LISTING

The instant application contains a Sequence Listing which has been submitted electronically in ASCII format and is hereby incorporated by reference in its entirety. Said ASCII copy, created on Feb. 16, 2021, is named 067461-5246-US_SL.txt and is 2,840,940 bytes in size.

BACKGROUND OF THE INVENTION

In order for T cells to mount an effective anti-tumor response, three things must occur. T cells must first engage antigenic tumor peptides presented by MHC in the tumor environment. Second, costimulatory molecules must bind to the T cells. And third, the T cells must be induced by cytokines such as IL-12 and IL-2 to produce costimulatory cytokines such as IFNγ which allows differentiation and expansion. Recognition of tumor peptides alone in the absence of cytokine induction leads to T cells becoming anergic, thereby leading to tolerance. Accordingly, a very promising approach in cancer immunotherapy is cytokine-based treatments. In fact, IL-2 has been approved for use in patients with metastatic renal-cell carcinoma and malignant melanoma. However, there are currently no approved uses of recombinant IL-12 in humans.

Recombinant IL-12 is a promising cytokine-based treatment due to its broad effect in activating the immune system. As described above, IL-12 induces T cell production of costimulatory cytokines such as IFNγ. IL-12 also leads to increased antigen presentation by dendritic cells (Grohmann U. et al., 1999) contributing to further T cell engagement of tumor peptides. In fact, murine IL-12 has been shown to effect anti-tumor activity in mice engrafted with tumors (Brunda, M J. Et al., 1993). However, IL-12 has thus far faced hurdles in human clinical trials due to systemic toxicity. As with other cytokines, the short half-life of IL-12 requires frequent bolus injections.

Immune checkpoint proteins such as PD-1 are up-regulated following T cell activation to preclude autoimmunity by exhausting activated T cells upon binding to immune checkpoint ligands such as PD-L1. However, immune checkpoint proteins such as PD-1 are also up-regulated in tumor-infiltrating lymphocytes (TILs), and immune checkpoint ligands such as PD-L1 are overexpressed on tumor cells, contributing to immune escape by tumor cells. De-repression of TILs by blockade of immune checkpoint interactions by drugs such as Opdivo® (nivolumab) and Keytruda® (pembrolizumab) have proven highly effective in treatment of cancer. Despite the promise of checkpoint blockade therapies such as nivolumab and pembrolizumab, many patients still fail to achieve sufficient response to checkpoint blockade alone.

Therefore, there remains an unmet need in oncology treatment for therapeutic strategies with cytokines which do not require high doses and are targeted to tumors to avoid systemic toxicity. Further, there is a need to identify additional therapeutic modalities to stack with checkpoint blockade that could increase patient response rate. This can be especially complex as the additional therapeutic modality should not compete with the checkpoint blockade. The present invention addresses these needs and caveats by providing PD-1 and PD-L1-targeted IL-12 fusion proteins with enhanced half-life and more selective targeting of TILs to improve safety profile, and which do not compete with checkpoint blockade antibodies with which they may be combined.

BRIEF SUMMARY OF THE INVENTION

Provided herein are targeted IL-12 heterodimeric Fc fusion proteins having a targeted scFv×scIL-12-Fc format, as depicted in FIG. 79A.

In one aspect, the present invention provides a targeted IL-12 heterodimeric Fc fusion protein comprising: (a) a first monomer comprising, from N- to C-terminal: (i) a first IL-12 protein domain; (ii) a first domain linker; (iii) a second IL-12 protein domain; iv) a second domain linker; and (v) a first variant Fc domain comprising CH2-CH3; and (b) a second monomer comprising, from N- to C-terminal: (i) an scFv domain; (ii) a third domain linker; (iii) a second variant Fc domain comprising CH2-CH3; wherein either the first IL-12 protein domain comprises an IL-12p35 subunit and the second IL-12 protein domain comprises an IL-12p40 subunit, or the first IL-12 protein domain comprises an IL-12p40 subunit and the second IL-12 protein domain comprises an IL-12p35 subunit, wherein the scFv domain comprises a variable heavy domain, an scFv linker, a variable light domain, and the scFv domain binds a target antigen, and wherein the first and the second variant Fc domains comprise modifications promoting heterodimerization of the first and the second Fc domains In some embodiments, the scFv domain binds a target antigen selected from the group consisting of human PD-1 and human PD-L1. In some embodiments, the scFv domain binds human PD-1. In some embodiments, the scFv domain binds human PD-1 and does not compete for the human PD-1 with nivolumab and/or pembrolizumab. In some embodiments, the scFv domain binds human PD-L1.

In some embodiments, the scFv domain that binds human PD-1 comprises a variable heavy chain and a variable light chain selected from the group consisting of: (a) 1C11[PD-1]_H0L0 (SEQ ID NOS:476 and 477), (b) 1C11[PD-1]_H3L3 (SEQ ID NOS:478 and 479), (c) 1C11[PD-1]_H3.240_L3.148 (SEQ ID NOS:480 and 481), (d) 1C11[PD-1]_H3.241_L3.148 (SEQ ID NOS:482 and 483), (e) 1C11[PD-1]_H3.234_L3.144 (SEQ ID NOS:484 and 485), (f) 1C11[PD-1]_H3.241_L3.92 (SEQ ID NOS:486 and 487), (g) 1C11[PD-1]_H3.303_L3.152 (SEQ ID NOS:488 and 489), (h) 1C11[PD-1]_H3.329_L3.220 (SEQ ID NOS:490 and 491), (i) 1C11[PD-1]_H3.329_L3.220 (SEQ ID NOS:490 and 491), (j) 1C11[PD-1]_H3.328_L3.152 (SEQ ID NOS:492 and 493), (k) pembrolizumab[PD-1] (SEQ ID NOS:494 and 495), (l) nivolizumab[PD-1] (SEQ ID NOS:355 and 356), (m) pidilizumab[PD-1] (SEQ ID NOS:498 and 499), (n) MK-3475[PD-1] (SEQ ID NOS:500 and 501), (o) BAP049 clone E[PD-1] (SEQ ID NOS:502 and 503), (p) BAP049 clone B[PD-1] (SEQ ID NOS:504 and 505), (q) H7709N [PD-1]_H7798N [PD-1] (SEQ ID NOS: 507 and 506), (r) H7798N [PD-1]_H7709N [PD-1] (SEQ ID NOS: 506 and 507), (s) h1H3 Var 6[PD-1] (SEQ ID NOS:508 and 509), (t) APE2058[PD-1] (SEQ ID NOS:510 and 511), (u) H005-1 [PD-1] (SEQ ID NOS:512 and 513), (v) 317-4B6

[PD-1] (SEQ ID NOS:514 and 515), (w) 326-4A3 [PD-1] (SEQ ID NOS:516 and 517), (x) hPD-1 mAb 7 [PD-1] (SEQ ID NOS:560 and 561), (y) Clone 38 [PD-1] (SEQ ID NOS:520 and 521), (z) Clone 39 [PD-1] (SEQ ID NOS:522 and 523), (aa) Clone 41 [PD-1] (SEQ ID NOS:524 and 525), (ab) Clone 48 [PD-1] (SEQ ID NOS:526 and 527), (ac) PD1-17 [PD-1] (SEQ ID NOS:528 and 529), (ad) PD1-28 [PD-1] (SEQ ID NOS:530 and 531), (ae) PD1-33 [PD-1] (SEQ ID NOS:532 and 533), (af) PD1-35 [PD-1] (SEQ ID NOS:534 and 534), (ag) LOPD180 [PD-1] (SEQ ID NOS: 536 and 537), (ah) Ab948 [PD-1] (SEQ ID NOS:538 and 539), (ai) humanized EH-12.2H7 [PD-1] (SEQ ID NOS:540 and 541), (aj) RG1H10 [PD-1] (SEQ ID NOS:542 and 543), (ak) RG1H10-H2A-22-1S [PD-1] (SEQ ID NOS:544 and 545), (al)) RG1H10-H2A-27-25 [PD-1] (SEQ ID NOS:546 and 547), (am) RG1H10-3C [PD-1] (SEQ ID NOS:548 and 549), (an) RG1H10-16C [PD-1] (SEQ ID NOS:550 and 551), (ao) RG1H10-17C [PD-1] (SEQ ID NOS:552 and 553), (ap) RG1H10-19C [PD-1] (SEQ ID NOS:554 and 555), (aq) RG1H10-21C [PD-1] (SEQ ID NOS:556 and 557), (ar) RG1H10-23C2 [PD-1] (SEQ ID NOS:558 and 559), and (as) mAB7 [PD-1] (SEQ ID NOS:560 and 561).

In some embodiments, the scFv domain binds human PD-1 and does not compete for the human PD-1 with nivolumab and/or pembrolizumab comprises a variable heavy chain and a variable light chain selected from the group consisting of: (i) mAb A[PD-1]_H1L1 (SEQ ID NOS:591 and 592), (ii) mAb B[PD-1]_H1L1 (SEQ ID NOS:593 and 594), (iii) mAb C[PD-1]_H1L1 (SEQ ID NOS:595 and 596), and (iv) mAb C[PD-1]_H1.19L1 (SEQ ID NOS: 569 and 567). In some embodiments, the scFv domain that binds human PD-1 and does not compete for the human PD-1 with nivolumab and/or pembrolizumab comprises: a variable heavy chain selected from the group consisting of: (a) mAb C[PD-1]_H1 (SEQ ID NO: 568), (b) mAb C[PD-1]_H1.19 (SEQ ID NO: 569), (c) mAb C[PD-1]_H1.48 (SEQ ID NO: 570), (d) mAb C[PD-1]_H1.125 (SEQ ID NO: 571), (e) mAb C[PD-1]_H1.130 (SEQ ID NO: 572), (f) mAb C[PD-1]_H1.132 (SEQ ID NO: 573), (g) mAb C[PD-1]_H1.169 (SEQ ID NO: 574), (h) mAb C[PD-1]_H1.175 (SEQ ID NO: 575), and (i) mAb C[PD-1]_H2 (SEQ ID NO: 576); and a variable light chain selected from the group consisting of: (a) mAb C[PD-1]_L1 (SEQ ID NO: 577), (b) mAb C[PD-1]_L1.1 (SEQ ID NO: 578), (c) mAb C[PD-1]_L1.3 (SEQ ID NO: 579), (d) mAb C[PD-1]_L1.45 (SEQ ID NO: 580), (e) mAb C[PD-1]_L1.117 (SEQ ID NO: 581), (f) mAb C[PD-1]_L1.129 (SEQ ID NO: 582), (g) mAb C[PD-1]_L1.135 (SEQ ID NO: 583), (h) mAb C[PD-1]_L1.136 (SEQ ID NO: 584), (i) mAb C[PD-1]_L1.140 (SEQ ID NO: 585), and (j) mAb C[PD-1]_L2 (SEQ ID NO: 586).

In some embodiments, the scFv domain that binds human PD-L1 comprises a variable heavy chain and a variable light chain selected from the group consisting of: (a) durvalumab (SEQ ID NOS: 597 and 598), (b) atezolizumab (SEQ ID NOS: 599 and 600), (c) A09-246-2 (SEQ ID NOS: 601 and 602), (d) 12A4 (SEQ ID NOS: 603 and 604), (e) 3G10 (SEQ ID NOS: 605 and 606), (f) 10A5 (SEQ ID NOS: 607 and 608), (f) h3D10 Var 1 (SEQ ID NOS: 609 and 610), (g) h3D10 Var 2 (SEQ ID NOS: 611 and 612), (h) h3D10 Var 3 (SEQ ID NOS: 613 and 614), (i) h3D10 Var 4 (SEQ ID NOS: 615 and 616), (j) h3D10 Var 5 (SEQ ID NOS: 617 and 618), (k) h3D10 Var 6 (SEQ ID NOS: 619 and 620), (l) h3D10 Var 7 (SEQ ID NO: 621 and 622), (m) h3D10 Var 8 (SEQ ID NOS: 623 and 624), (n) h3D10 Var 9 (SEQ ID NOS: 625 and 626), (o) h3D10 Var 10 (SEQ ID NOS: 627 and 628), (p) h3D10 Var 11 (SEQ ID NOS: 629 and 630), (q) h3D10 Var 12 (SEQ ID NOS: 631 and 632), (r) h3D10 Var 13 (SEQ ID NOS: 633 and 634), (s) h3D10 Var 14 (SEQ ID NOS: 635 and 636), (t) Antibody A (SEQ ID NOS: 637 and 638), (u) C5H9v2 (SEQ ID NOS: 639 and 640), (v) humanized 29E.2A3 (SEQ ID NOS: 641 and 642), (w) 1B9 (SEQ ID NOS: 643 and 644), (x) 4H1 (SEQ ID NOS: 645 and 646), (y) mAb-42 (SEQ ID NOS: 647 and 648), (z) BAP058-03 (SEQ ID NOS: 649 and 650), (aa) BAP058-04 (SEQ ID NOS: 651 and 652), (ab) BAP058-06 (SEQ ID NOS: 653 and 654), (ac) BAP058-07 (SEQ ID NOS: 655 and 656), (ad) BAP058-11 (SEQ ID NOS: 657 and 658), (ae) BAP058-13 (SEQ ID NOS: 659 and 660), (af) H6 (SEQ ID NOS: 661 and 662), (ag) RC5 (SEQ ID NOS: 663 and 664), (ah) SH1A1Q (SEQ ID NOS: 665 and 666), (ai) SH1B3 (SEQ ID NOS: 667 and 668), (aj) SH1D1 (SEQ ID NOS: 669 and 670), (ak) SH1D2 (SEQ ID NOS: 671 and 672), (al) SH1D12 (SEQ ID NOS: 673 and 674), (am) SH1E1 (SEQ ID NOS: 675 and 676), (an) SH1G9 (SEQ ID NOS: 677 and 678), (ao) SH1E6 (SEQ ID NOS: 679 and 680), (ap) SH1A2 (SEQ ID NOS: 681 and 682), (aq) SH1B1 (SEQ ID NOS: 683 and 684), (ar) H6B1L (SEQ ID NOS: 685 and 686), (as) H6A1 (SEQ ID NOS: 687 and 688), (at) H6B1 (SEQ ID NOS: 689 and 690), (au) H6B2 (SEQ ID NOS: 691 and 692), (av) G12 (SEQ ID NOS: 693 and 694), (aw) RSA1 (SEQ ID NOS: 695 and 696), (ax) RA3 (SEQ ID NOS: 697 and 698), (ay) SH1E2 (SEQ ID NOS: 699 and 700), (az) SH1E4 (SEQ ID NOS: 701 and 702), (ba) SH1B1 (SEQ ID NOS: 683 and 684), (bb) SH1C8 (SEQ ID NOS: 705 and 706), (bc) H1H9364P2 (SEQ ID NOS: 707 and 708), (bd) H1H9373P2 (SEQ ID NOS: 709 and 710), (be) H1H8314N (SEQ ID NOS: 711 and 712), and (bf) PDL1.3 (SEQ ID NOS: 713 and 714).

In some embodiments, the modifications promoting heterodimerization of the first and the second Fc domains are a set of amino acid substitutions selected from the group consisting of L368D/K370S and S364K; L368D/K370S and S364K/E357L; L368D/K370S and S364K/E357Q; T411E/K360E/Q362E and D401K; L368E/K370S and S364K; K370S and S364K/E357Q; T366S/L368A/Y407V and T366W; and T366S/L368A/Y407V/Y349C and T366W/S354C, according to EU numbering.

In some embodiments, the first and/or the second variant Fc domains have an additional set of amino acid substitutions comprising Q295E/N384D/Q418E/N421D, according to EU numbering. In some embodiments, the first variant Fc domain or the second variant Fc domain has an additional set of amino acid substitutions comprising Q295E/N384D/Q418E/N421D, according to EU numbering. In some embodiments, the first and the second variant Fc domains each have an additional set of amino acid substitutions comprising Q295E/N384D/Q418E/N421D, according to EU numbering.

In some embodiments, the first and/or the second variant Fc domains have an additional set of amino acid substitutions consisting of G236R/L328R, E233P/L234V/L235A/G236del/S239K, E233P/L234V/L235A/G236del/S239K/A327G, E233P/L234V/L235A/G236del/S267K/A327G, E233P/L234V/L235A/G236del, and E233P/L234V/L235A/G236del/S267K, according to EU numbering. In some embodiments, the first variant Fc domain or the second variant Fc domain has an additional set of amino acid substitutions consisting of G236R/L328R, E233P/L234V/L235A/G236del/S239K, E233P/L234V/L235A/G236del/S239K/A327G, E233P/L234V/L235A/G236del/S267K/A327G, E233P/L234V/L235A/G236del, and E233P/L234V/L235A/G236del/S267K, according to EU numbering. In some embodiments, the first and the second variant Fc domains have an additional set of amino acid substitutions consisting of G236R/L328R, E233P/L234V/L235A/G236del/S239K, E233P/L234V/L235A/G236del/S239K/A327G, E233P/L234V/L235A/G236del/S267K/A327G, E233P/L234V/L235A/G236del, and E233P/L234V/L235A/G236del/S267K, according to EU numbering.

In some embodiments, the first and the second variant Fc domains each comprise amino acid substitutions M428L/N434S, according to EU numbering.

In some embodiments, the IL-12p40 subunit has a polypeptide sequence selected from the group consisting of SEQ ID NO:3 (human IL-12 subunit beta (IL-12p40) precursor sequence) and SEQ ID NO:4 (human IL-12 subunit beta (IL-12p40) mature form sequence), and the IL-12p35 subunit has a polypeptide sequence selected from the group consisting of SEQ ID NO:1 (human IL-12 subunit alpha (IL-12p35) precursor sequence) and SEQ ID NO:2 (human IL-12 subunit alpha (IL-12p35) mature form sequence). In some embodiments, the IL-12p40 subunit is a variant IL-12p40 subunit and/or the IL-12p35 subunit is a variant IL-12p35 subunit.

In some embodiments, the IL-12p40 subunit is a variant IL-12p40 subunit having altered affinity for IL-12 receptor subunit beta-1 (IL-12R(31), IL-12 receptor subunit beta-2 (IL-12R(32), and/or IL-12 receptor complex; and/or the IL-12p35 subunit is a variant IL-12p35 subunit having altered affinity for IL-12 receptor subunit beta-1 (IL-12R(31), IL-12 receptor subunit beta-2 (IL-12R(32), and/or IL-12 receptor complex.

In some embodiments, the IL-12p40 subunit is a variant IL-12p40 subunit having altered affinity for IL-12 receptor subunit beta-1 (IL-12R(31), IL-12 receptor subunit beta-2 (IL-12R(32), and/or IL-12 receptor complex. In some embodiments, the IL-12p35 subunit is a variant IL-12p35 subunit having altered affinity for IL-12 receptor subunit beta-1 (IL-12R(31), IL-12 receptor subunit beta-2 (IL-12R(32), and/or IL-12 receptor complex.

In some embodiments, the IL-12p40 subunit has one or more amino acid substitutions at amino acid residues selected from the group consisting of E59, K99, D18, K264, C252, N200, E3, D7, E12, D14, W15, P17, A19, P20, G21, E22, M23, D29, E32, E33, D34, L40, D41, Q42, S43, E45, L47, T54, I55, Q56, K58, F60, G61, D62, Q65, Y66, E73, K84, E86, D87, G88, I89, W90, D93, D97, E100, K102, N103, K104, F106, E110, N113, Y114, D129, D142, Q144, E156, R159, D161, N162, K163, D166, D170, Q172, D174, A176, C177, P178, A179, A180, E181, S183, P185, E187, S204, F206, R208, D209, D214, N218, Q220, N226, Q229, E231, E235, T242, P243, S245, Y246, F247, S248, Q256, K258, K260, E262, D265, D270, N281, Q289, D290, R291, Y292, Y293, and E299.

In certain embodiments, the IL-12p40 subunit has one or more amino acid substitutions selected from the group consisting of E59K, K99E, K99Y, D18K, K264E, C252S, N200Q, D18N, E32Q, E33Q, D34K, D34N, Q42E, S43E, S43K, E45Q, Q56E, E59Q, D62N, E73Q, D87N, E100Q, N103D, N103Q, N113D, N113Q, Q144E, R159E, D161N, K163E, E187Q, N200D, N218Q, Q229E, E235Q, Q256N, K258E, K260E, E262Q, N281D, N281Q, and E299Q.

In some embodiments, the IL-12p40 subunit has amino acid substitutions selected from the group consisting of: E59K/K99E, E59K/K99Y, D18K/E59K/K99E, E59K/K99E/K264E, D18K/E59K/K99E/K264E, E59K/K99E/C252S, E59K/K99Y/C252S, D18K/E59K/K99E/C252S, E59K/K99E/C252S/K264E, D18K/E59K/K99E/C252S/K264E, E59K/K99E/N200Q, E59K/K99Y/N200Q, D18K/E59K/K99E/N200Q, E59K/K99E/N200Q/K264E, D18K/E59K/K99E/N200Q/K264E, E59K/K99E/N200Q/C252S, E59K/K99Y/N200Q/C252S, D18K/E59K/K99E/N200Q/C252S, E59K/K99E/N200Q/C252S/K264E, D18K/E59K/K99E/N200Q/C252S/K264E, D18K/E59K/K99E/C252S, E32K/D34N/E59K/K99E, E32Q/D34N/E59K/K99E, D34K/E59K/K99E, D34N/E59K, D34N/E59K/K99E, Q42E/E45Q, Q42E/E59Q, Q42E/Q56E/E59Q, E32Q/E59Q, D34N/E59Q, S43E/E59Q, S43K/E49Q, E45K/E59K/K99E, E45Q/Q56E, E45Q/Q56E/E59Q, E59Q/E187Q, E59Q/K163E, E59Q/K99E, E59Q/K258E, E59Q/K260E, E59K/K99E/N103Q/C252S/K264E, E59K/K99E/Q144E, E59K/K99E/Q144K, E59K/K99E/R159E, E59K/K99Y, E59Y/K99E, E59Y/K99Y, E59K/K99E/N113Q/C252S/K264E, E59K/K99E/N281Q/C252S/K264E, E59K/K99E/N103Q/N113Q/C252S/K264E, E59K/K99E/N103Q/N200Q/C252S/K264E, E59K/K99E/N103Q/N281Q/C252S/K264E, E59K/K99E/N113Q/N200Q/C252S/K264E, E59K/K99E/N113Q/N281Q/C252S/K264E, E59K/K99E/N200Q/N281Q/C252S/K264E, E59K/K99E/N103Q/N113Q/N200Q/C252S/K264E, E59K/K99E/N103Q/N200Q/N281Q/C252S/K264E, E59K/K99E/N113Q/N200Q/N281Q/C252S/K264E, E59K/K99E/N103Q/N113Q/N200Q/N281Q/C252S/K264E, N103D/N113D, N103D/N113D/N200D, N103D/N113D/N281D, N103D/N200D, N103D/N200D/N281D, N103D/N281D, N103D/N113D/N200D/N281D, N103Q/N113Q, N103Q/N113Q/N200Q, N103Q/N113Q/N281Q, N103Q/N200Q, N103Q/N200Q/N281Q, N103Q/N281Q, N113D/N200D, N113D/N200D/N281D, N113D/N281D, N113D/N200Q, N113D/N281Q, N113Q/N200Q/N281Q, N103Q/N113Q/N200Q/N281Q, N200D/N281D, and N200Q/N281Q.

In some embodiments, the IL-12p40 subunit or variant IL-12p40 subunit comprises amino acid substitutions selected from the group consisting of E59K/K99E, E59K/K99Y, D18K/E59K/K99E, E59K/K99E/K264E, D18K/E59K/K99E/K264E, E59K/K99E/C252S, E59K/K99Y/C252S, D18K/E59K/K99E/C252S, E59K/K99E/C252S/K264E, D18K/E59K/K99E/C252S/K264E, E59K/K99E/N200Q, E59K/K99Y/N200Q, D18K/E59K/K99E/N200Q, E59K/K99E/N200Q/K264E, D18K/E59K/K99E/N200Q/K264E, E59K/K99E/N200Q/C252S, E59K/K99Y/N200Q/C252S, D18K/E59K/K99E/N200Q/C252S, E59K/K99E/N200Q/C252S/K264E, and D18K/E59K/K99E/N200Q/C252S/K264E.

In certain embodiments, the IL-12p40 subunit has a polypeptide sequence selected from the group consisting of: any one depicted in FIGS. 89A-89C, i) SEQ ID NO:57 (IL-12p40(N103D)), ii) SEQ ID NO:58 (IL-12p40 (N113D)), iii) SEQ ID NO:59 (IL-12p40(N200D)), iv) SEQ ID NO:60 (IL-12p40(N281D)), v) SEQ ID NO:61 (IL-12p40(N103D/N113D/N200D/N281D)), vi) SEQ ID NO:62 (IL-12p40(Q42E)), vii) SEQ ID NO:63 (IL-12p40(E45Q)), viii) SEQ ID NO:64 (IL-12p40(Q56E)), ix) SEQ ID NO:65 (IL-12p40(E59Q)), x) SEQ ID NO:66 (IL-12p40(D62N)), xi) SEQ ID NO:67 (IL-12p40(Q42E/E45Q)), xii) SEQ ID NO:68 (IL-12p40(E45Q/Q56E)), xiii) SEQ ID NO:69 (IL-12p40(Q42E/E59Q)), xiv) SEQ ID NO:70 (IL-12p40(Q56E/E59Q)), xv) SEQ ID NO:71 (IL-12p40(Q42E/E45Q/Q56E)), xvi) SEQ ID NO:72 (IL-12p40(E45Q/Q56E/E59Q)), xvii) SEQ ID NO:73 (IL-12p40(D161N)), xviii) SEQ ID NO:74 (IL-12p40(E73Q)), xix) SEQ ID NO:75 (IL-12p40(Q144E)), xx) SEQ ID NO:76 (IL-12p40 (E262Q)), xxi) SEQ ID NO:77 (IL-12p40(E100Q)), xxii) SEQ ID NO:78 (IL-12p40(D18N)), xxiii) SEQ ID NO:79 (IL-12p40(E33Q)), xxiv) SEQ ID NO:80 (IL-12p40 (Q229E)), xxv) SEQ ID NO:81 (IL-12p40(E235Q)), xxvi)

SEQ ID NO:82 (IL-12p40(Q256N)), xxvii) SEQ ID NO:83 (IL-12p40(E299Q)), xxviii) SEQ ID NO:84 (IL-12p40 (D87N)), xxix) IL-12p40(E32Q), xxx) IL-12p40(D34N), xxxi) IL-12p40(S43E), xxxii) IL-12p40(S43K), xxxiii) SEQ ID NO:379 (IL-12p40 (E59K/K99E/N103Q/N113Q/N200Q/N281Q/C252S/K264E)), xxxiv) SEQ ID NO:205 (IL-12p40(E59K)), xxxv) IL-12p40(K99E), xxxvi) IL-12p40(K163E), xxxvii) IL-12p40(E187Q), xxxviii) IL-12p40(K258E), xxxix) IL-12p40(K260E), xl) SEQ ID NO:206 (IL-12p40(E32Q/E59Q)), xli) SEQ ID NO:207 (IL-12p40(D34N/E59Q)), xlii) SEQ ID NO:208 (IL-12p40(E59Q/E187Q)), xliii) SEQ ID NO:209 (IL-12p40(S43E/E59Q)), xliv) SEQ ID NO:210 (IL-12p40(S43K/E59Q)), xlv) SEQ ID NO:211 (IL-12p40(E59Q/K163E)), xlvi) SEQ ID NO:212 (IL-12p40(E59Q/K99E)), xlvii) SEQ ID NO:213 (IL-12p40(E59Q/K258E)), xlviii) SEQ ID NO:214 (IL-12p40(E59Q/K260E)), xlix) SEQ ID NO: 326 (IL-12p40 (D34N/E59N)) l) SEQ ID NO: 325 (IL-12p40(E59K/K99E)), li) SEQ ID NO: 339 (IL-12p40(D18K/E59K/K99E)), lii) SEQ ID NO: 343 (IL-12p40 (E59K/K99E/K264E)), liii) SEQ ID NO: 336 (IL-12p40 (E59K/K99Y)), liv) SEQ ID NO: 335 (IL-12p40 (E59Y/K99E)), lv) SEQ ID NO: 338 (IL-12p40 (E45K/E59K/K99E)), lvi) SEQ ID NO: 340 (IL-12p40 (E59K/K99E/Q144E)), lvii) SEQ ID NO: 341 (IL-12p40 (E59K/K99E/Q144K)), lviii) SEQ ID NO: 342 (IL-12p40 (E59K/K99E/R159E)), lix) SEQ ID NO: 343 (IL-12p40 (E59K/K99E/K264E)), lx) SEQ ID NO: 344 (IL-12p40 (D18K/E59K/K99E/K264E)), lxi) SEQ ID NO: 360 (IL-12p40 (C252S)), lxii) SEQ ID NO: 361 (IL-12p40 (D18K/E59K/K99E/C252S)), lxiii) SEQ ID NO: 362 (IL-12p40 (D18K/E59K/K99E/C252S/K264E)), lxiv) SEQ ID NO: 363 (IL-12p40 (E59K/K99Y/C252S)), lxv) SEQ ID NO: 364 (IL-12p40 (E59K/K99E/C252S/K264E)), lxvi) SEQ ID NO: 365 (IL-12p40 (E59K/K99E/C252S)), lxvii) SEQ ID NO: 254 (IL-12p40 (N103D/N113D)), lxviii) SEQ ID NO: 255 (IL-12p40 (N103D/N200D)), lxix) SEQ ID NO: 256 (IL-12p40 (N103D/N281D)), lxx) SEQ ID NO: 257 (IL-12p40 (N113D/N200D)), lxxi) SEQ ID NO: 258 (IL-12p40 (N113D/N281D)), lxxii) SEQ ID NO: 259 (IL-12p40 (N200D/N281D)), lxxiii) SEQ ID NO: 260 (IL-12p40 (N103D/N113D/N200D)), lxxiv) SEQ ID NO: 261 (IL-12p40 (N103D/N113D/N281D)), lxxv) SEQ ID NO: 262 (IL-12p40 (N103D/N200D/N281D)), lxxvi) SEQ ID NO: 263 (IL-12p40 (N113D/N200D/N281D)), lxxvii) SEQ ID NO: 264 (IL-12p40 (N103Q), lxxviii) SEQ ID NO: 265 (IL-12p40 (N113Q)), lxxix) SEQ ID NO: 266 (IL-12p40 (N200Q)), lxxx) SEQ ID NO: 267 (IL-12p40 (N281Q)), lxxxi) SEQ ID NO: 268 (IL-12p40 (N103Q/N113Q)), lxxxii) SEQ ID NO: 269 (IL-12p40 (N103Q/N200Q)), lxxxiii) SEQ ID NO: 270 (IL-12p40 (N103Q/N281Q)), lxxxiv) SEQ ID NO: 271 (IL-12p40 (N113Q/N200Q)), lxxxv) SEQ ID NO: 272 (IL-12p40 (N113Q/N281Q)), lxxxvi) SEQ ID NO: 273 (IL-12p40 (N200Q/N281Q)), lxxxvii) SEQ ID NO: 274 (IL-12p40 (N103Q/N113Q/N200Q)), lxxxviii) SEQ ID NO: 275 (IL-12p40 (N103Q/N113Q/N281Q)), lxxxix) SEQ ID NO: 276 (IL-12p40 (N103Q/N200Q/N281Q)), xc) SEQ ID NO: 277 (IL-12p40 (N113Q/N200Q/N281Q)), xci) SEQ ID NO:278 (IL-12p40 (N103Q/N113Q/N200Q/N281Q)), xcii) SEQ ID NO:327 (IL-12p40 (D34N/E59K/K99E)), xciii) SEQ ID NO:328 (IL-12p40 (D34K/E59K/K99E)), xciv) SEQ ID NO:329 (IL-12p40 (E32Q/D34N/E59K/K99E)), xcv) SEQ ID NO:331 (IL-12p40 (E32K/D34N/E59K/K99E)), xcvi) SEQ ID NO: 337 (IL-12p40 (E59Y/K99Y)), xcvii) SEQ ID NO:366 (IL-12p40 (E59K/K99E/N103Q/C252S/K264E)), xcviii) SEQ ID NO:367 (IL-12p40 (E59K/K99E/N113Q/C252S/K264E)), xcix) SEQ ID NO:368 (IL-12p40 (E59K/K99E/N200Q/C252S/K264E)), c) SEQ ID NO:369 (IL-12p40 (E59K/K99E/N281Q/C252S/K264E)), ci) SEQ ID NO:370 (IL-12p40 (E59K/K99E/N103Q/N113Q/C252S/K264E)), cii) SEQ ID NO:371 (IL-12p40 (E59K/K99E/N103Q/N200Q/C252S/K264E)), ciii) SEQ ID NO:372 (IL-12p40 (E59K/K99E/N103Q/N281Q/C252S/K264E)), civ) SEQ ID NO:373 (IL-12p40 (E59K/K99E/N113Q/N200Q/C252S/K264E)), cv) SEQ ID NO:374 (IL-12p40 (E59K/K99E/N113Q/N281Q/C252S/K264E)), cvi) SEQ ID NO:375 (IL-12p40 (E59K/K99E/N200Q/N281Q/C252S/K264E)), cvii) SEQ ID NO:376 (IL-12p40 (E59K/K99E/N103Q/N113Q/N200Q/C252S/K264E)), cviii) SEQ ID NO:377 (IL-12p40 (E59K/K99E/N103Q/N200Q/N281Q/C252S/K264E)), and cix) SEQ ID NO:378 (IL-12p40 (E59K/K99E/N113Q/N200Q/N281Q/C252S/K264E)).

In some embodiments, the IL-12p35 subunit has one or more amino acid substitutions as amino acid residues selected from the group consisting of Q20, N21, Q35, E38, S44, E45, E46, H49, K54, D55, T59, V60, E61, C63, L64, P65, E67, L68, N71, S73, C74, L75, N76, E79, N85, L89, F96, M97, L124, M125, Q130, Q135, N136, E143, Q146, N151, E153, K158, E162, E163, D165, I171, R181, I182, R183, V185, T186, D188, R189, V190, S192, Y193, N195, and A196. In certain embodiments, the IL-12p35 subunit has one or more amino acid substitutions selected from the group consisting of N21D, Q35D, E38Q, D55Q, D55K, N71D, N71Q, L75A, N76D, E79Q, N85D, N85Q, L89A, F96A, M97A, L124A, M125A, Q130E, Q135E, N136D, E143Q, Q146E, N151D, N151K, E153K, E153Q, K158E, E162Q, E163Q, D165N, I171A, N195D, and N195Q. In some embodiments, the IL-12p35 subunit has one or more amino acid substitutions selected from the group consisting of N21D/N151D, D55Q/N151D, N71D/N85D, N71D/N85D/N195D, N71D/N195D, N71Q/N85Q, N71Q/N85Q/N195Q, N71Q/N195Q, E79Q/N151D, N85D/N195D, N85Q/N195Q, Q130E/N151D, N136D/N151D, E143Q/N151D, N151D/E153Q, N151D/D165N, and N151D/K158E.

In some embodiments, the IL-12p35 subunit has one or more amino acid substitutions selected from the group consisting of: i) SEQ ID NO:113 (IL-12p35(N71D)), ii) SEQ ID NO:114 (IL-12p35(N85D)), iii) SEQ ID NO:115 (IL-12p35(N195D)), iv) SEQ ID NO:116 (IL-12p35(N71D/N85D/N195D)), v) SEQ ID NO:117 (IL-12p35(E153Q)), vi) SEQ ID NO:118 (IL-12p35(E38Q)), vii) SEQ ID NO:119 (IL-12p35(N151D)), viii) SEQ ID NO:120 (IL-12p35(Q135E)), ix) SEQ ID NO:121 (IL-12p35(Q35D)), x) SEQ ID NO:122 (IL-12p35(Q146E)), xi) SEQ ID NO:123 (IL-12p35(N76D)), xii) SEQ ID NO:124 (IL-12p35 (E162Q)), xiii) SEQ ID NO:125 (IL-12p35(E163Q)), xiv) IL-12p35(N21D), xv) SEQ ID NO:333 (IL-12p35(D55Q)), xvi) IL-12p35(E79Q), xvii) IL-12p35(Q130E), xviii) IL-12p35(N136D), xix) IL-12p35(E143Q), xx) SEQ ID NO:227 (IL-12p35(N151K)), xxi) SEQ ID NO:226 (IL-12p35(E153K)), xxii) IL-12p35(K158E), xxiii) IL-12p35 (D165N), xxiv) SEQ ID NO:225 (IL-12p35(N151D/E153Q)), xxv) SEQ ID NO:228 (IL-12p35(N151D/D165N)), xxvi) SEQ ID NO:229 (IL-12p35(Q130E/N151D)), xxvii) SEQ ID NO:230 (IL-12p35(N151D/K158E)), xxviii) SEQ ID NO:231 (IL-12p35(E79Q/N151D)), xxix) SEQ ID NO:232 (IL-12p35(D55Q/N151D)), xxx) SEQ ID NO:233 (IL-12p35(N136D/N151D)), xxxi) SEQ ID NO:234 (IL-12p35(N21D/N151D)), xxxii) SEQ ID NO:235 (IL-12p35(E143Q/N151D)), xxxiii) SEQ ID NO: 345 (IL-12p35(F96A)), xxxiv) SEQ ID NO: 346 (IL-12p35(M97A)), xxxv) SEQ ID NO: 347 (IL-12p35(L89A)), xxxvi) SEQ ID NO: 348 (IL- 12p35(L124A)), xxxvii) SEQ ID NO: 349 (IL-12p35 (M125A)), xxxviii) SEQ ID NO: 350 (IL-12p35(L75A)), xxxiv) SEQ ID NO: 351 (IL-12p35(I171A)), xxxv) SEQ ID NO: 279 (IL-12p35 (N71Q)), xxxvi) SEQ ID NO: 280 (IL-12p35 (N85Q)), xxxvii) SEQ ID NO: 281 (IL-12p35 (N195Q)), xxxviii) SEQ ID NO: 282 (IL-12p35 (N71Q/N85Q)), xxxix) SEQ ID NO: 283 (IL-12p35 (N71Q/N195Q)), xl) SEQ ID NO: 284 (IL-12p35 (N85Q/N195Q), xli) SEQ ID NO: 285 (IL-12p35 (N71Q/N85Q/N195Q)), xlii) SEQ ID NO: 286 (IL-12p35 (N71D/N85D)), xliii) SEQ ID NO: 287 (IL-12p35 (N71D/N195D), xliv) SEQ ID NO: 288 (IL-12p35 (N85D/N195D)), xlv) SEQ ID NO: 333 (IL-12p35 (D55Q)), and xlvi) SEQ ID NO: 334 (IL-12p35 (D55K)).

Provided herein are targeted IL-12 heterodimeric Fc fusion proteins having a targeted Fab×scIL-12-Fc format, as depicted in FIG. 79B.

In one aspect, the present invention provides a targeted IL-12 heterodimeric Fc fusion protein comprising: (a) a first monomer comprising, from N- to C-terminal: (i) a first IL-12 protein domain; (ii) a first domain linker; (iii) a second IL-12 protein domain; (iv) a first variant Fc domain; (b) a second monomer comprising a heavy chain comprising VH-CH1-hinge-CH2-CH3, wherein the CH2-CH3 is a second variant Fc domain; and (c) a third monomer comprising a light chain comprising VL-CL; wherein the VH and VL domains form an antigen binding domain that binds a target antigen; wherein either the first IL-12 protein domain comprises an IL-12p35 subunit and the second IL-12 protein domain comprises an IL-12p40 subunit, or the first IL-12 protein domain comprises an IL-12p40 subunit and the second IL-12 protein domain comprises an IL-12p35 subunit, wherein the first and the second variant Fc domains comprise modification promoting heterodimerization of the first and second variant Fc domains.

In some embodiments, the antigen binding domain binds a target antigen selected from the group consisting of human PD-1 and human PD-L1. In some embodiments, the antigen binding domain binds human PD-1. In some embodiments, the antigen binding domain binds human PD-1 and does not compete for the human PD-1 with nivolumab and/or pembrolizumab. In some embodiments, the antigen binding domain binds human PD-L1.

In some embodiments, the antigen binding domain that binds human PD-1 comprises a VH domain and a VL domain selected from the group consisting of: (a) 1C11[PD-1]_H0L0 (SEQ ID NOS:476 and 477), (b) 1C11[PD-1]_H3L3 (SEQ ID NOS:478 and 479), (c) 1C11[PD-1]_H3.240_L3.148 (SEQ ID NOS:480 and 481), (d) 1C11[PD-1]_H3.241_L3.148 (SEQ ID NOS:482 and 483), (e) 1C11[PD-1]_H3.234_L3.144 (SEQ ID NOS:484 and 485), (f) 1C11[PD-1]_H3.241_L3.92 (SEQ ID NOS:486 and 487), (g) 1C11[PD-1]_H3.303_L3.152 (SEQ ID NOS:488 and 489), (h) 1C11[PD-1]_H3.329_L3.220 (SEQ ID NOS:490 and 491), (i) 1C11[PD-1]_H3.329_L3.220 (SEQ ID NOS: 490 and 491), (j) 1C11[PD-1]_H3.328_L3.152 (SEQ ID NOS:492 and 493), (k) pembrolizumab[PD-1] (SEQ ID NOS:494 and 495), (l) nivolizumab[PD-1] (SEQ ID NOS: 355 and 356), (m) pidilizumab[PD-1] (SEQ ID NOS:498 and 499), (n) MK-3475[PD-1] (SEQ ID NOS:500 and 501), (o) BAP049 clone E[PD-1] (SEQ ID NOS:502 and 503), (p) BAP049 clone B[PD-1] (SEQ ID NOS:504 and 505), H7709N [PD-1]_H7798N [PD-1] (SEQ ID NOS: 507 and 506), (r) H7798N [PD-1]_H7709N [PD-1] (SEQ ID NOS: 506 and 507), (s) h1H3 Var 6[PD-1] (SEQ ID NOS:508 and 509), (t) APE2058[PD-1] (SEQ ID NOS:510 and 511), (u) H005-1 [PD-1] (SEQ ID NOS:512 and 513), (v) 317-4B6 [PD-1] (SEQ ID NOS:514 and 515), (w) 326-4A3 [PD-1] (SEQ ID NOS:516 and 517), (x) hPD-1 mAb 7 [PD-1] (SEQ ID NOS:520 and 561), (y) Clone 38 [PD-1] (SEQ ID NOS:520 and 521), (z) Clone 39 [PD-1] (SEQ ID NOS:522 and 523), (aa) Clone 41 [PD-1] (SEQ ID NOS:524 and 525), (ab) Clone 48 [PD-1] (SEQ ID NOS:526 and 527), (ac) PD1-17 [PD-1] (SEQ ID NOS:528 and 529), (ad) PD1-28 [PD-1] (SEQ ID NOS:530 and 531), (ae) PD1-33 [PD-1] (SEQ ID NOS:532 and 533), (af) PD1-35 [PD-1] (SEQ ID NOS:534 and 535), (ag) LOPD180 [PD-1] (SEQ ID NOS: 536 and 537), (ah) Ab948 [PD-1] (SEQ ID NOS:538 and 539), (ai) humanized EH-12.2H7 [PD-1] (SEQ ID NOS:540 and 541), (aj) RG1H10 [PD-1] (SEQ ID NOS:542 and 543), (ak) RG1H10-H2A-22-1S [PD-1] (SEQ ID NOS:544 and 545), (al)) RG1H10-H2A-27-25 [PD-1] (SEQ ID NOS:546 and 547), (am) RG1H10-3C [PD-1] (SEQ ID NOS:548 and 549), (an) RG1H10-16C [PD-1] (SEQ ID NOS:550 and 551), (ao) RG1H10-17C [PD-1] (SEQ ID NOS:552 and 553), (ap) RG1H10-19C [PD-1] (SEQ ID NOS:554 and 555), (aq) RG1H10-21C [PD-1] (SEQ ID NOS:556 and 557), (ar) RG1H10-23C2 [PD-1] (SEQ ID NOS:558 and 559), and (as) mAB7 [PD-1] (SEQ ID NOS:560 and 561).

In some embodiments, the antigen binding domain that binds human PD-1 and does not compete for the human PD-1 with nivolumab and/or pembrolizumab comprises a VH domain and a VL domain selected from the group consisting of: (i) mAb A[PD-1]_H1L1 (SEQ ID NOS:591 and 592), (ii) mAb B[PD-1]_H1L1 (SEQ ID NOS:593 and 594), (iii) mAb C[PD-1]_H1L1 (SEQ ID NOS:595 and 596), and (iv) mAb C[PD-1]_H1.19L1 (SEQ ID NOS:569 and 567). In some embodiments, the scFv domain that binds human PD-1 and does not compete for the human PD-1 with nivolumab and/or pembrolizumab comprises: a variable heavy chain selected from the group consisting of: (a) mAb C[PD-1]_H1 (SEQ ID NO: 568), (b) mAb C[PD-1]_H1.19 (SEQ ID NO: 569), (c) mAb C[PD-1]_H1.48 (SEQ ID NO: 570), (d) mAb C[PD-1]_H1.125 (SEQ ID NO: 571), (e) mAb C[PD-1]_H1.130 (SEQ ID NO: 572), (f) mAb C[PD-1]_H1.132 (SEQ ID NO: 573), (g) mAb C[PD-1]_H1.169 (SEQ ID NO: 574), (h) mAb C[PD-1]_H1.175 (SEQ ID NO: 575), and (i) mAb C[PD-1]_H2 (SEQ ID NO: 576); and a variable light chain selected from the group consisting of: (a) mAb C[PD-1]_L1 (SEQ ID NO: 577), (b) mAb C[PD-1]_L1.1 (SEQ ID NO: 578), (c) mAb C[PD-1]_L1.3 (SEQ ID NO: 579), (d) mAb C[PD-1]_L1.45 (SEQ ID NO: 580), (e) mAb C[PD-1]_L1.117 (SEQ ID NO: 581), (f) mAb C[PD-1]_L1.129 (SEQ ID NO: 582), (g) mAb C[PD-1]_L1.135 (SEQ ID NO: 583), (h) mAb C[PD-1]_L1.136 (SEQ ID NO: 584), (i) mAb C[PD-1]_L1.140 (SEQ ID NO: 585), and (j) mAb C[PD-1]_L2 (SEQ ID NO: 586).

In certain embodiments, the antigen binding domain that binds human PD-1 and does not compete for the human PD-1 with nivolumab and/or pembrolizumab comprises: a VH domain selected from the group consisting of: (a) mAb C[PD-1]_H1 (SEQ ID NO: 568), (b) mAb C[PD-1]_H1.19 (SEQ ID NO: 569), (c) mAb C[PD-1]_H1.48 (SEQ ID NO: 570), (d) mAb C[PD-1]_H1.125 (SEQ ID NO: 571), (e) mAb C[PD-1]_H1.130 (SEQ ID NO: 572), (f) mAb C[PD-1]_H1.132 (SEQ ID NO: 573), (g) mAb C[PD-1]_H1.169 (SEQ ID NO: 574), (h) mAb C[PD-1]_H1.175 (SEQ ID NO: 575), and (i) mAb C[PD-1]_H2 (SEQ ID NO: 576); and a VL domain selected from the group consisting of: (a) mAb C[PD-1]_L1 (SEQ ID NO: 577), (b) mAb C[PD-1]_L1.1 (SEQ ID NO: 578), (c) mAb C[PD-1]_L1.3 (SEQ ID NO: 579), (d) mAb C[PD-1]_L1.45 (SEQ ID NO: 580), (e) mAb C[PD-1]_L1.117 (SEQ ID NO: 581), (f) mAb C[PD-1]_L1.129 (SEQ ID NO: 582), (g) mAb C[PD-1]_L1.135

(SEQ ID NO: 583), (h) mAb C[PD-1]_L1.136 (SEQ ID NO: 584), (i) mAb C[PD-1]_L1.140 (SEQ ID NO: 585), and (j) mAb C[PD-1]_L2 (SEQ ID NO: 586).

In some embodiments, the antigen binding domain that binds human PD-L1 comprises a VH domain and a VL domain selected from the group consisting of: (a) durvalumab (SEQ ID NOS: 597 and 598), (b) atezolizumab (SEQ ID NOS: 599 and 600), (c) A09-246-2 (SEQ ID NOS: 601 and 602), (d) 12A4 (SEQ ID NOS: 603 and 604), (e) 3G10 (SEQ ID NOS: 605 and 606), (f) 10A5 (SEQ ID NOS: 607 and 608), (f) h3D10 Var 1 (SEQ ID NOS: 609 and 610), (g) h3D10 Var 2 (SEQ ID NOS: 611 and 612), (h) h3D10 Var 3 (SEQ ID NOS: 613 and 614), (i) h3D10 Var 4 (SEQ ID NOS: 615 and 616), (j) h3D10 Var 5 (SEQ ID NOS: 617 and 618), (k) h3D10 Var 6 (SEQ ID NOS: 619 and 620), (l) h3D10 Var 7 (SEQ ID NOS: 621 and 622), (m) h3D10 Var 8 (SEQ ID NOS: 623 and 624), (n) h3D10 Var 9 (SEQ ID NOS: 625 and 626), (o) h3D10 Var 10 (SEQ ID NOS: 627 and 628), (p) h3D10 Var 11 (SEQ ID NOS: 629 and 630), (q) h3D10 Var 12 (SEQ ID NOS: 631 and 632), (r) h3D10 Var 13 (SEQ ID NOS: 633 and 634), (s) h3D10 Var 14 (SEQ ID NOS: 635 and 636), (t) Antibody A (SEQ ID NOS: 637 and 638), (u) C5H9v2 (SEQ ID NOS: 639 and 640), (v) humanized 29E.2A3 (SEQ ID NOS: 641 and 642), (w) 1B9 (SEQ ID NOS: 643 and 644), (x) 4H1 (SEQ ID NOS: 645 and 646), (y) mAb-42 (SEQ ID NOS: 647 and 648), (z) BAP058-03 (SEQ ID NOS: 649 and 650), (aa) BAP058-04 (SEQ ID NOS: 651 and 652), (ab) BAP058-06 (SEQ ID NOS: 653 and 654), (ac) BAP058-07 (SEQ ID NOS: 655 and 656), (ad) BAP058-11 (SEQ ID NOS: 657 and 658), (ae) BAP058-13 (SEQ ID NOS: 659 and 660), (af) H6 (SEQ ID NOS: 661 and 662), (ag) RC5 (SEQ ID NOS: 663 and 664), (ah) SH1A1Q (SEQ ID NOS: 665 and 666), (ai) SH1B3 (SEQ ID NOS: 667 and 668), (aj) SH1D1 (SEQ ID NOS: 669 and 670), (ak) SH1D2 (SEQ ID NOS: 671 and 672), (al) SH1D12 (SEQ ID NOS: 673 and 674), (am) SH1E1 (SEQ ID NOS: 675 and 676), (an) SH1G9 (SEQ ID NOS: 677 and 678), (ao) SH1E6 (SEQ ID NOS: 679 and 680), (ap) SH1A2 (SEQ ID NOS: 681 and 682), (aq) SH1B1 (SEQ ID NOS: 683 and 684), (ar) H6B1L (SEQ ID NOS: 685 and 686), (as) H6A1 (SEQ ID NOS: 687 and 688), (at) H6B1 (SEQ ID NOS: 689 and 690), (au) H6B2 (SEQ ID NOS: 691 and 692), (av) G12 (SEQ ID NOS: 693 and 694), (aw) RSA1 (SEQ ID NOS: 695 and 696), (ax) RA3 (SEQ ID NOS: 697 and 698), (ay) SH1E2 (SEQ ID NOS: 699 and 700), (az) SH1E4 (SEQ ID NOS: 701 and 702), (ba) SH1B1 (SEQ ID NOS: 683 and 684), (bb) SH1C8 (SEQ ID NOS: 705 and 706), (bc) H1H9364P2 (SEQ ID NOS: 707 and 708), (bd) H1H9373P2 (SEQ ID NOS: 709 and 710), (be) H1H8314N (SEQ ID NOS: 711 and 712), and (bf) PDL1.3 (SEQ ID NOS: 713 and 714).

In some embodiments, the modifications promoting heterodimerization of the first and the second Fc domains are a set of amino acid substitutions selected from the group consisting of L368D/K370S and S364K; L368D/K370S and S364K/E357L; L368D/K370S and S364K/E357Q; T411E/K360E/Q362E and D401K; L368E/K370S and S364K; K370S and S364K/E357Q; T366S/L368A/Y407V and T366W; and T366S/L368A/Y407V/Y349C and T366W/S354C, according to EU numbering.

In some embodiments, the first and/or the second variant Fc domains have an additional set of amino acid substitutions comprising Q295E/N384D/Q418E/N421D, according to EU numbering. In some embodiments, the first variant Fc domain or the second variant Fc domain has an additional set of amino acid substitutions comprising Q295E/N384D/Q418E/N421D, according to EU numbering. In some embodiments, the first and the second variant Fc domains each have an additional set of amino acid substitutions comprising Q295E/N384D/Q418E/N421D, according to EU numbering.

In some embodiments, the first and/or the second variant Fc domains have an additional set of amino acid substitutions consisting of G236R/L328R, E233P/L234V/L235A/G236del/S239K, E233P/L234V/L235A/G236del/S239K/A327G, E233P/L234V/L235A/G236del/S267K/A327G, E233P/L234V/L235A/G236del, and E233P/L234V/L235A/G236del/S267K, according to EU numbering. In some embodiments, the first variant Fc domain or the second variant Fc domain has an additional set of amino acid substitutions consisting of G236R/L328R, E233P/L234V/L235A/G236del/S239K, E233P/L234V/L235A/G236del/S239K/A327G, E233P/L234V/L235A/G236del/S267K/A327G, E233P/L234V/L235A/G236del, and E233P/L234V/L235A/G236del/S267K, according to EU numbering. In some embodiments, the first and the second variant Fc domains have an additional set of amino acid substitutions consisting of G236R/L328R, E233P/L234V/L235A/G236del/S239K, E233P/L234V/L235A/G236del/S239K/A327G, E233P/L234V/L235A/G236del/S267K/A327G, E233P/L234V/L235A/G236del, and E233P/L234V/L235A/G236del/S267K, according to EU numbering.

In some embodiments, the first and the second variant Fc domains each comprise amino acid substitutions M428L/N434S, according to EU numbering.

In some embodiments, the IL-12p40 subunit has a polypeptide sequence selected from the group consisting of SEQ ID NO:3 (human IL-12 subunit beta (IL-12p40) precursor sequence) and SEQ ID NO:4 (human IL-12 subunit beta (IL-12p40) mature form sequence), and the IL-12p35 subunit has a polypeptide sequence selected from the group consisting of SEQ ID NO:1 (human IL-12 subunit alpha (IL-12p35) precursor sequence) and SEQ ID NO:2 (human IL-12 subunit alpha (IL-12p35) mature form sequence). In some embodiments, the IL-12p40 subunit is a variant IL-12p40 subunit and/or the IL-12p35 subunit is a variant IL-12p35 subunit.

In some embodiments, the IL-12p40 subunit is a variant IL-12p40 subunit having altered affinity for IL-12 receptor subunit beta-1 (IL-12R(31), IL-12 receptor subunit beta-2 (IL-12R(32), and/or IL-12 receptor complex; and/or the IL-12p35 subunit is a variant IL-12p35 subunit having altered affinity for IL-12 receptor subunit beta-1 (IL-12R (31), IL-12 receptor subunit beta-2 (IL-12R(32), and/or IL-12 receptor complex.

In some embodiments, the IL-12p40 subunit is a variant IL-12p40 subunit having altered affinity for IL-12 receptor subunit beta-1 (IL-12R(31), IL-12 receptor subunit beta-2 (IL-12R(32), and/or IL-12 receptor complex. In some embodiments, the IL-12p35 subunit is a variant IL-12p35 subunit having altered affinity for IL-12 receptor subunit beta-1 (IL-12R(31), IL-12 receptor subunit beta-2 (IL-12R (32), and/or IL-12 receptor complex.

In some embodiments, the IL-12p40 subunit has one or more amino acid substitutions at amino acid residues selected from the group consisting of E59, K99, D18, K264, C252, N200, E3, D7, E12, D14, W15, P17, A19, P20, G21, E22, M23, D29, E32, E33, D34, L40, D41, Q42, S43, E45, L47, T54, I55, Q56, K58, F60, G61, D62, Q65, Y66, E73, K84, E86, D87, G88, I89, W90, D93, D97, E100, K102, N103, K104, F106, E110, N113, Y114, D129, D142, Q144, E156, R159, D161, N162, K163, D166, D170, Q172, D174, A176, C177, P178, A179, A180, E181, S183, P185, E187, S204, F206, R208, D209, D214, N218, Q220, N226, Q229, E231, E235, T242, P243, S245, Y246, F247, S248, Q256, K258, K260, E262, D265, D270, N281, Q289, D290, R291, Y292, Y293, and E299.

In certain embodiments, the IL-12p40 subunit has one or more amino acid substitutions selected from the group consisting of E59K, K99E, K99Y, D18K, K264E, C252S, N200Q, D18N, E32Q, E33Q, D34K, D34N, Q42E, S43E, S43K, E45Q, Q56E, E59Q, D62N, E73Q, D87N, E100Q, N103D, N103Q, N113D, N113Q, Q144E, R159E, D161N, K163E, E187Q, N200D, N218Q, Q229E, E235Q, Q256N, K258E, K260E, E262Q, N281D, N281Q, and E299Q.

In some embodiments, the IL-12p40 subunit has amino acid substitutions selected from the group consisting of: E59K/K99E, E59K/K99Y, D18K/E59K/K99E, E59K/K99E/K264E, D18K/E59K/K99E/K264E, E59K/K99E/C252S, E59K/K99Y/C252S, D18K/E59K/K99E/C252S, E59K/K99E/C252S/K264E, D18K/E59K/K99E/C252S/K264E, E59K/K99E/N200Q, E59K/K99Y/N200Q, D18K/E59K/K99E/N200Q, E59K/K99E/N200Q/K264E, D18K/E59K/K99E/N200Q/K264E, E59K/K99E/N200Q/C252S, E59K/K99Y/N200Q/C252S, D18K/E59K/K99E/N200Q/C252S, E59K/K99E/N200Q/C252S/K264E, D18K/E59K/K99E/N200Q/C252S/K264E, D18K/E59K/K99E/C252S, E32K/D34N/E59K/K99E, E32Q/D34N/E59K/K99E, D34K/E59K/K99E, D34N/E59K, D34N/E59K/K99E, Q42E/E45Q, Q42E/E59Q, Q42E/Q56E/E59Q, E32Q/E59Q, D34N/E59Q, S43E/E59Q, S43K/E49Q, E45K/E59K/K99E, E45Q/Q56E, E45Q/Q56E/E59Q, E59Q/E187Q, E59Q/K163E, E59Q/K99E, E59Q/K258E, E59Q/K260E, E59K/K99E/N103Q/C252S/K264E, E59K/K99E/Q144E, E59K/K99E/Q144K, E59K/K99E/R159E, E59K/K99Y, E59Y/K99E, E59Y/K99Y, E59K/K99E/N113Q/C252S/K264E, E59K/K99E/N281Q/C252S/K264E, E59K/K99E/N103Q/N113Q/C252S/K264E, E59K/K99E/N103Q/N200Q/C252S/K264E, E59K/K99E/N103Q/N281Q/C252S/K264E, E59K/K99E/N113Q/N200Q/C252S/K264E, E59K/K99E/N113Q/N281Q/C252S/K264E, E59K/K99E/N200Q/N281Q/C252S/K264E, E59K/K99E/N103Q/N113Q/N200Q/C252S/K264E, E59K/K99E/N103Q/N200Q/N281Q/C252S/K264E, E59K/K99E/N113Q/N200Q/N281Q/C252S/K264E, E59K/K99E/N103Q/N113Q/N200Q/N281Q/C252S/K264E, N103D/N113D, N103D/N113D/N281D, N103D/N200D, N103D/N113D/N200D, N103D/N200D/N281D, N103D/N281D, N103D/N113D/N200D/N281D, N103Q/N113Q, N103Q/N113Q/N200Q, N103Q/N113Q/N281Q, N103Q/N200Q, N103Q/N200Q/N281Q, N103Q/N281Q, N113D/N200D, N113D/N200D/N281D, N113D/N281D, N113Q/N200Q, N113Q/N281Q, N113Q/N200Q/N281Q, N103Q/N113Q/N200Q/N281Q, N200D/N281D, and N200Q/N281Q.

In some embodiments, the IL-12p40 subunit or variant IL-12p40 subunit comprises amino acid substitutions selected from the group consisting of E59K/K99E, E59K/K99Y, D18K/E59K/K99E, E59K/K99E/K264E, D18K/E59K/K99E/K264E, E59K/K99E/C252S, E59K/K99Y/C252S, D18K/E59K/K99E/C252S, E59K/K99E/C252S/K264E, D18K/E59K/K99E/C252S/K264E, E59K/K99E/N200Q, E59K/K99Y/N200Q, D18K/E59K/K99E/N200Q, E59K/K99E/N200Q/K264E, D18K/E59K/K99E/N200Q/K264E, E59K/K99E/N200Q/C252S, E59K/K99Y/N200Q/C252S, D18K/E59K/K99E/N200Q/C252S, E59K/K99E/N200Q/C252S/K264E, and D18K/E59K/K99E/N200Q/C252S/K264E.

In certain embodiments, the IL-12p40 subunit has a polypeptide sequence selected from the group consisting of: i) SEQ ID NO:57 (IL-12p40(N103D)), ii) SEQ ID NO:58 (IL-12p40(N113D)), iii) SEQ ID NO:59 (IL-12p40(N200D)), iv) SEQ ID NO:60 (IL-12p40(N281D)), v) SEQ ID NO:61 (IL-12p40(N103D/N113D/N200D/N281D)), vi) SEQ ID NO:62 (IL-12p40(Q42E)), vii) SEQ ID NO:63 (IL-12p40(E45Q)), viii) SEQ ID NO:64 (IL-12p40(Q56E)), ix) SEQ ID NO:65 (IL-12p40(E59Q)), x) SEQ ID NO:66 (IL-12p40(D62N)), xi) SEQ ID NO:67 (IL-12p40(Q42E/E45Q)), xii) SEQ ID NO:68 (IL-12p40(E45Q/Q56E)), xiii) SEQ ID NO:69 (IL-12p40(Q42E/E59Q)), xiv) SEQ ID NO:70 (IL-12p40(Q56E/E59Q)), xv) SEQ ID NO:71 (IL-12p40(Q42E/E45Q/Q56E)), xvi) SEQ ID NO:72 (IL-12p40(E45Q/Q56E/E59Q)), xvii) SEQ ID NO:73 (IL-12p40(D161N)), xviii) SEQ ID NO:74 (IL-12p40(E73Q)), xix) SEQ ID NO:75 (IL-12p40(Q144E)), xx) SEQ ID NO:76 (IL-12p40(E262Q)), xxi) SEQ ID NO:77 (IL-12p40(E100Q)), xxii) SEQ ID NO:78 (IL-12p40(D18N)), xxiii) SEQ ID NO:79 (IL-12p40(E33Q)), xxiv) SEQ ID NO:80 (IL-12p40(Q229E)), xxv) SEQ ID NO:81 (IL-12p40(E235Q)), xxvi) SEQ ID NO:82 (IL-12p40(Q256N)), xxvii) SEQ ID NO:83 (IL-12p40(E299Q)), xxviii) SEQ ID NO:84 (IL-12p40(D87N)), xxix) IL-12p40(E32Q), xxx) IL-12p40(D34N), xxxi) IL-12p40(S43E), xxxii) IL-12p40(S43K), xxxiii) SEQ ID NO:379 (IL-12p40 (E59K/K99E/N103Q/N113Q/N200Q/N281Q/C252S/K264E)), xxxiv) SEQ ID NO:205 (IL-12p40(E59K)), xxxv) IL-12p40(K99E), xxxvi) IL-12p40(K163E), xxxvii) IL-12p40(E187Q), xxxviii) IL-12p40(K258E), xxxix) IL-12p40(K260E), xl) SEQ ID NO:206 (IL-12p40(E32Q/E59Q)), xli) SEQ ID NO:207 (IL-12p40(D34N/E59Q)), xlii) SEQ ID NO:208 (IL-12p40(E59Q/E187Q)), xliii) SEQ ID NO:209 (IL-12p40(S43E/E59Q)), xliv) SEQ ID NO:210 (IL-12p40(S43K/E59Q)), xlv) SEQ ID NO:211 (IL-12p40(E59Q/K163E)), xlvi) SEQ ID NO:212 (IL-12p40(E59Q/K99E)), xlvii) SEQ ID NO:213 (IL-12p40(E59Q/K258E)), xlviii) SEQ ID NO:214 (IL-12p40(E59Q/K260E)), xlix) SEQ ID NO: 326 (IL-12p40 (D34N/E59K)) l) SEQ ID NO: 325 (IL-12p40(E59K/K99E)), li) SEQ ID NO: 339 (IL-12p40(D18K/E59K/K99E)), lii) SEQ ID NO: 343 (IL-12p40 (E59K/K99E/K264E)), liii) SEQ ID NO: 336 (IL-12p40 (E59K/K99Y)), liv) SEQ ID NO: 335 (IL-12p40 (E59Y/K99E)), lv) SEQ ID NO: 338 (IL-12p40 (E45K/E59K/K99E)), lvi) SEQ ID NO: 340 (IL-12p40 (E59K/K99E/Q144E)), lvii) SEQ ID NO: 341 (IL-12p40 (E59K/K99E/Q144K)), lviii) SEQ ID NO: 342 (IL-12p40 (E59K/K99E/R159E)), lix) SEQ ID NO: 343 (IL-12p40 (E59K/K99E/K264E)), lx) SEQ ID NO: 344 (IL-12p40 (D18K/E59K/K99E/K264E)), lxi) SEQ ID NO: 360 (IL-12p40 (C252S)), lxii) SEQ ID NO: 361 (IL-12p40 (D18K/E59K/K99E/C252S)), lxiii) SEQ ID NO: 362 (IL-12p40 (D18K/E59K/K99E/C252S/K264E)), lxiv) SEQ ID NO: 363 (IL-12p40 (E59K/K99Y/C252S)), lxv) SEQ ID NO: 364 (IL-12p40 (E59K/K99E/C252S/K264E)), lxvi) SEQ ID NO: 365 (IL-12p40 (E59K/K99E/C252S)), lxvii) SEQ ID NO: 254 (IL-12p40 (N103D/N113D)), lxviii) SEQ ID NO: 255 (IL-12p40 (N103D/N200D)), lxix) SEQ ID NO: 256 (IL-12p40 (N103D/N281D)), lxx) SEQ ID NO: 257 (IL-12p40 (N113D/N200D)), lxxi) SEQ ID NO: 258 (IL-12p40 (N113D/N281D)), lxxii) SEQ ID NO: 259 (IL-12p40 (N200D/N281D)), lxxiii) SEQ ID NO: 260 (IL-12p40 (N103D/N113D/N200D)), lxxiv) SEQ ID NO: 261 (IL-12p40 (N103D/N113D/N281D)), lxxv) SEQ ID NO: 262 (IL-12p40 (N103D/N200D/N281D)), lxxvi) SEQ ID NO: 263 (IL-12p40 (N113D/N200D/N281D)), lxxvii) SEQ ID NO: 264 (IL-12p40 (N103Q)), lxxviii) SEQ ID NO: 265 (IL-12p40 (N113Q)), lxxix) SEQ ID NO: 266 (IL-12p40 (N200Q)), lxxx) SEQ ID NO: 267 (IL-12p40 (N281Q)), lxxxi) SEQ ID NO: 268 (IL-12p40 (N103Q/N113Q)), lxxxii) SEQ ID NO: 269 (IL-12p40 (N103Q/N200Q)), lxxxiii) SEQ ID NO: 270 (IL-12p40 (N103Q/N281Q)), lxxxiv) SEQ ID NO: 271 (IL-12p40 (N113Q/N200Q)), lxxxv) SEQ ID NO: 272 (IL-12p40 (N113Q/N281Q)), lxxxvi) SEQ ID NO: 273 (IL-12p40 (N200Q/N281Q)), lxxxvii) SEQ ID NO: 274 (IL-12p40 (N103Q/N113Q/N200Q)), lxxxviii) SEQ ID NO: 275 (IL-12p40 (N103Q/N113Q/N281Q)), lxxxix) SEQ ID NO: 276 (IL-12p40 (N103Q/N200Q/N281Q)), xc) SEQ ID NO: 277 (IL-12p40 (N113Q/N200Q/N281Q)), xci) SEQ ID NO:278 (IL-12p40 (N103Q/N113Q/N200Q/N281Q)), xcii) SEQ ID NO:327 (IL-12p40 (D34N/E59K/K99E)), xciii) SEQ ID NO:328 (IL-12p40 (D34K/E59K/K99E)), xciv) SEQ ID NO:329 (IL-12p40 (E32Q/D34N/E59K/K99E)), xcv) SEQ ID NO:331 (IL-12p40 (E32K/D34N/E59K/K99E)), xcvi) SEQ ID NO: 337 (IL-12p40 (E59Y/K99Y)), xcvii) SEQ ID NO:366 (IL-12p40 (E59K/K99E/N103Q/C252S/K264E)), xcviii) SEQ ID NO:367 (IL-12p40 (E59K/K99E/N113Q/C252S/K264E)), xcix) SEQ ID NO:368 (IL-12p40 (E59K/K99E/N200Q/C252S/K264E)), c) SEQ ID NO:369 (IL-12p40 (E59K/K99E/N281Q/C252S/K264E)), ci) SEQ ID NO:370 (IL-12p40 (E59K/K99E/N103Q/N113Q/C252S/K264E)), cii) SEQ ID NO:371 (IL-12p40 (E59K/K99E/N103Q/N200Q/C252S/K264E)), ciii) SEQ ID NO:372 (IL-12p40 (E59K/K99E/N103Q/N281Q/C252S/K264E)), civ) SEQ ID NO:373 (IL-12p40 (E59K/K99E/N113Q/N200Q/C252S/K264E)), cv) SEQ ID NO:374 (IL-12p40 (E59K/K99E/N113Q/N281Q/C252S/K264E)), cvi) SEQ ID NO:375 (IL-12p40 (E59K/K99E/N200Q/N281Q/C252S/K264E)), cvii) SEQ ID NO:376 (IL-12p40 (E59K/K99E/N103Q/N113Q/N200Q/C252S/K264E)), cviii) SEQ ID NO:377 (IL-12p40 (E59K/K99E/N103Q/N200Q/N281Q/C252S/K264E)), and cix) SEQ ID NO:378 (IL-12p40 (E59K/K99E/N113Q/N200Q/N281Q/C252S/K264E)).

In some embodiments, the IL-12p35 subunit has one or more amino acid substitutions as amino acid residues selected from the group consisting of Q20, N21, Q35, E38, S44, E45, E46, H49, K54, D55, T59, V60, E61, C63, L64, P65, E67, L68, N71, S73, C74, L75, N76, E79, N85, L89, F96, M97, L124, M125, Q130, Q135, N136, E143, Q146, N151, E153, K158, E162, E163, D165, I171, R181, I182, R183, V185, T186, D188, R189, V190, S192, Y193, N195, and A196. In certain embodiments, the IL-12p35 subunit has one or more amino acid substitutions selected from the group consisting of N21D, Q35D, E38Q, D55Q, D55K, N71D, N71Q, L75A, N76D, E79Q, N85D, N85Q, L89A, F96A, M97A, L124A, M125A, Q130E, Q135E, N136D, E143Q, Q146E, N151D, N151K, E153K, E153Q, K158E, E162Q, E163Q, D165N, I171A, N195D, and N195Q. In some embodiments, the IL-12p35 subunit has one or more amino acid substitutions selected from the group consisting of N21D/N151D, D55Q/N151D, N71D/N85D, N71D/N85D/N195D, N71D/N195D, N71Q/N85Q, N71Q/N85Q/N195Q, N71Q/N195Q, E79Q/N151D, N85D/N195D, N85Q/N195Q, Q130E/N151D, N136D/N151D, E143Q/N151D, N151D/E153Q, N151D/D165N, and N151D/K158E.

In some embodiments, the IL-12p35 subunit has one or more amino acid substitutions selected from the group consisting of: i) SEQ ID NO:113 (IL-12p35(N71D)), ii) SEQ ID NO:114 (IL-12p35(N85D)), iii) SEQ ID NO:115 (IL-12p35(N195D)), iv) SEQ ID NO:116 (IL-12p35(N71D/N85D/N195D)), v) SEQ ID NO:117 (IL-12p35(E153Q)), vi) SEQ ID NO:118 (IL-12p35(E38Q)), vii) SEQ ID NO:119 (IL-12p35(N151D)), viii) SEQ ID NO:120 (IL-12p35(Q135E)), ix) SEQ ID NO:121 (IL-12p35(Q35D)), x) SEQ ID NO:122 (IL-12p35(Q146E)), xi) SEQ ID NO:123 (IL-12p35(N76D)), xii) SEQ ID NO:124 (IL-12p35(E162Q)), xiii) SEQ ID NO:125 (IL-12p35(E163Q)), xiv) IL-12p35(N21D), xv) SEQ ID NO:333 (IL-12p35(D55Q)), xvi) IL-12p35(E79Q), xvii) IL-12p35(Q130E), xviii) IL-12p35(N136D), xix) IL-12p35(E143Q), xx) SEQ ID NO:227 (IL-12p35(N151K)), xxi) SEQ ID NO:226 (IL-12p35(E153K)), xxii) IL-12p35(K158E), xxiii) IL-12p35 (D165N), xxiv) SEQ ID NO:225 (IL-12p35(N151D/E153Q)), xxv) SEQ ID NO:228 (IL-12p35(N151D/D165N)), xxvi) SEQ ID NO:229 (IL-12p35(Q130E/N151D)), xxvii) SEQ ID NO:230 (IL-12p35(N151D/K158E)), xxviii) SEQ ID NO:231 (IL-12p35(E79Q/N151D)), xxix) SEQ ID NO:232 (IL-12p35(D55Q/N151D)), xxx) SEQ ID NO:233 (IL-12p35(N136D/N151D)), xxxi) SEQ ID NO:234 (IL-12p35(N21D/N151D)), xxxii) SEQ ID NO:235 (IL-12p35(E143Q/N151D)), xxxiii) SEQ ID NO: 345 (IL-12p35(F96A)), xxxiv) SEQ ID NO: 346 (IL-12p35(M97A)), xxxv) SEQ ID NO: 347 (IL-12p35(L89A)), xxxvi) SEQ ID NO: 348 (IL-12p35(L124A)), xxxvii) SEQ ID NO: 349 (IL-12p35 (M125A)), xxxviii) SEQ ID NO: 350 (IL-12p35(L75A)), xxxiv) SEQ ID NO: 351 (IL-12p35(I171A)), xxxv) SEQ ID NO: 279 (IL-12p35 (N71Q)), xxxvi) SEQ ID NO: 280 (IL-12p35 (N85Q)), xxxvii) SEQ ID NO: 281 (IL-12p35 (N195Q)), xxxviii) SEQ ID NO: 282 (IL-12p35 (N71Q/N85Q)), xxxix) SEQ ID NO: 283 (IL-12p35 (N71Q/N195Q)), xl) SEQ ID NO: 284 (IL-12p35 (N85Q/N195Q), xli) SEQ ID NO: 285 (IL-12p35 (N71Q/N85Q/N195Q)), xlii) SEQ ID NO: 286 (IL-12p35 (N71D/N85D)), xliii) SEQ ID NO: 287 (IL-12p35 (N71D/N195D), xliv) SEQ ID NO: 288 (IL-12p35 (N85D/N195D)), xlv) SEQ ID NO: 333 (IL-12p35 (D55Q)), and xlvi) SEQ ID NO: 334 (IL-12p35 (D55K)).

In some embodiments, the targeted IL-12 heterodimeric Fc fusion protein described herein is selected from the group consisting of XENP28792, XENP28793, XENP28794, XENP28796, XENP31073, XENP31074, XENP31106, XENP31136, XENP31137, XENP31140, XENP31460, XENP31461, XENP31462, XENP31585, XENP31586, XENP32192, XENP32193, XENP32194, XENP32195, XENP31108, XENP31463, XENP31464, XENP31465, XENP33686, XENP33687, XENP33693, XENP33694, XENP33695, XENP33696, XENP33697, XENP33685, XENP33688, XENP33689, XENP33690, XENP33691, XENP33692, and any depicted in FIGS. 80A-80H, 81A-81B, 82A-82H, 98A-B, 99A-B, 100A-100D, 101A-101D, 102A-102D, 103A-103D, 104A-104D, 105A-105D, 106, 107A-107B, 108A-108D, 109A-109D, 110A-110D, 111A-111D, 112A-112D, 113A-113D, 114A-114B, 115A-115D, 116A-116D, 117A-117D, 118A-118D, 119A-119D, 120A-120D, and 121A-121D.

Provided herein are targeted IL-12 heterodimeric Fc fusion proteins having a targeted mAbxFc-scIL-12 format, as depicted in FIG. 79C.

In one aspect, the present invention provides a targeted IL-12 heterodimeric Fc fusion protein comprising: (a) a first monomer comprising, from N- to C-terminal: a heavy chain comprising VH-CH1-hinge-CH2-CH3, wherein the CH2-CH3 is a first variant Fc domain; (b) a second monomer comprising, from N- to C-terminal: VH-CH1-hinge-CH2-CH3-domain linker-a first IL-12 protein domain-domain linker-a second IL-12 protein domain, wherein the CH2-CH3 is a second variant Fc domain; (c) a third monomer comprising, from N- to C-terminal: a light chain comprising VL-CL, wherein the VH and VL domains form an antigen binding domain that binds a target antigen, wherein either the first IL-12 protein domain comprises an IL-12p35 subunit and the second IL-12 protein domain comprises an IL-12p40 subunit, or the first IL-12 protein domain comprises an IL-12p40 subunit and the second IL-12 protein domain comprises an IL-12p35 subunit, and wherein the first and the second variant Fc domains comprise modification promoting heterodimerization of the first and second variant Fc domains.

Provided herein are targeted IL-12 heterodimeric Fc fusion proteins having a targeted central x IL-12-Fc format, as depicted in FIG. 79D.

In another aspect, the present invention provides a targeted IL-12 heterodimeric Fc fusion protein comprising: (a) a first monomer comprising, from N- to C-terminal: a VH-CH1-a first domain linker-an IL-12p35 subunit-an optional domain linker-CH2-CH3, wherein the CH2-CH3 is a first variant Fc domain; (b) a second monomer comprising, from N- to C-terminal: a VH-CH1-a first domain linker-an IL-12p40 subunit-an optional domain linker-CH2-CH3, wherein the CH2-CH3 is a second variant Fc domain; and (c) a third monomer comprising, from N- to C-terminal: a light chain comprising VL-CL, wherein the VH and VL domains form an antigen binding domain that binds a target antigen, and wherein the first and the second variant Fc domains comprise modification promoting heterodimerization of the first and second variant Fc domains.

Provided herein are targeted IL-12 heterodimeric Fc fusion proteins having a targeted central x scIL-12-Fc format, as depicted in FIG. 79E.

In another aspect, the present invention provides a targeted IL-12 heterodimeric Fc fusion protein comprising: (a) a first monomer comprising, from N- to C-terminal: a VH-CH1-domain linker-a first IL-12 protein domain-domain linker-a second IL-12 protein domain-domain linker-CH2-CH3, wherein the CH2-CH3 is a first variant Fc domain; b) a second monomer comprising, from N- to C-terminal: a heavy chain comprising VH-CH1-hinge-CH2-CH3, wherein the CH2-CH3 is a second variant Fc domain; (c) a third monomer comprising, from N- to C-terminal: a light chain comprising VL-CL; wherein the VH and VL domains form an antigen binding domain that binds a target antigen, wherein either the first IL-12 protein domain comprises an IL-12p35 subunit and the second IL-12 protein domain comprises an IL-12p40 subunit, or the first IL-12 protein domain comprises an IL-12p40 subunit and the second IL-12 protein domain comprises an IL-12p35 subunit, and wherein the first and the second variant Fc domains comprise modification promoting heterodimerization of the first and second variant Fc domains.

In some embodiments of any one of the targeted IL-12-Fc fusion formats, the antigen binding domain binds a target antigen selected from the group consisting of human PD-1 and human PD-L1. In some embodiments, the antigen binding domain binds human PD-1. In some embodiments, the antigen binding domain binds human PD-1 and does not compete for the human PD-1 with nivolumab and/or pembrolizumab. In some embodiments, the antigen binding domain binds human PD-L1.

In some embodiments of any one of the targeted IL-12-Fc fusion formats, the antigen binding domain that binds human PD-1 comprises a VH domain and a VL domain selected from the group consisting of: (a) 1C11[PD-1]_H0L0 (SEQ ID NOS:476 and 477), (b) 1C11[PD-1]_H3L3 (SEQ ID NOS:478 and 479), (c) 1C11[PD-1]_H3.240_L3.148 (SEQ ID NOS:480 and 481), (d) 1C11[PD-1]_H3.241_L3.148 (SEQ ID NOS:482 and 483), (e) 1C11[PD-1]_H3.234_L3.144 (SEQ ID NOS:484 and 485), (f) 1C11[PD-1]_H3.241_L3.92 (SEQ ID NOS:486 and 487), (g) 1C11[PD-1]_H3.303_L3.152 (SEQ ID NOS:488 and 489), (h) 1C11[PD-1]_H3.329_L3.220 (SEQ ID NOS:490 and 491), (i) 1C11[PD-1]_H3.329_L3.220 (SEQ ID NOS: 490 and 491), (j) 1C11[PD-1]_H3.328_L3.152 (SEQ ID NOS:492 and 493), (k) pembrolizumab[PD-1] (SEQ ID NOS:494 and 495), (l) nivolizumab[PD-1] (SEQ ID NOS: 355 and 356), (m) pidilizumab[PD-1] (SEQ ID NOS:498 and 499), (n) MK-3475[PD-1] (SEQ ID NOS:500 and 501), (o) BAP049 clone E[PD-1] (SEQ ID NOS:502 and 503), (p) BAP049 clone B[PD-1] (SEQ ID NOS:504 and 505), (q) H7709N [PD-1]_H7798N [PD-1] (SEQ ID NOS: 507 and 506), (r) H7798N [PD-1]_H7709N [PD-1] (SEQ ID NOS: 506 and 507), (s) h1H3 Var 6[PD-1] (SEQ ID NOS:508 and 509), (t) APE2058[PD-1] (SEQ ID NOS:510 and 511), (u) H005-1 [PD-1] (SEQ ID NOS:512 and 513), (v) 317-4B6 [PD-1] (SEQ ID NOS:514 and 515), (w) 326-4A3 [PD-1] (SEQ ID NOS:516 and 517), (x) hPD-1 mAb 7 [PD-1] (SEQ ID NOS:560 and 561), (y) Clone 38 [PD-1] (SEQ ID NOS:520 and 521), (z) Clone 39 [PD-1] (SEQ ID NOS:522 and 523), (aa) Clone 41 [PD-1] (SEQ ID NOS:524 and 525), (ab) Clone 48 [PD-1] (SEQ ID NOS:526 and 527), (ac) PD1-17 [PD-1] (SEQ ID NOS:528 and 529), (ad) PD1-28 [PD-1] (SEQ ID NOS:530 and 531), (ae) PD1-33 [PD-1] (SEQ ID NOS:532 and 533), (af) PD1-35 [PD-1] (SEQ ID NOS:534 and 535), (ag) LOPD180 [PD-1] (SEQ ID NOS: 536 and 537), (ah) Ab948 [PD-1] (SEQ ID NOS:538 and 539), (ai) humanized EH-12.2H7 [PD-1] (SEQ ID NOS:540 and 541), (aj) RG1H10 [PD-1] (SEQ ID NOS:542 and 543), (ak) RG1H10-H2A-22-1S [PD-1] (SEQ ID NOS:544 and 545), (al)) RG1H10-H2A-27-25 [PD-1] (SEQ ID NOS:546 and 547), (am) RG1H10-3C [PD-1] (SEQ ID NOS:548 and 549), (an) RG1H10-16C [PD-1] (SEQ ID NOS:550 and 551), (ao) RG1H10-17C [PD-1] (SEQ ID NOS:552 and 553), (ap) RG1H10-19C [PD-1] (SEQ ID NOS:554 and 555), (aq) RG1H10-21C [PD-1] (SEQ ID NOS:556 and 557), (ar) RG1H10-23C2 [PD-1] (SEQ ID NOS:558 and 559), and (as) mAB7 [PD-1] (SEQ ID NOS:560 and 561).

In some embodiments of any one of the targeted IL-12-Fc fusion formats, the antigen binding domain that binds human PD-1 and does not compete for the human PD-1 with nivolumab and/or pembrolizumab comprises a VH domain and a VL domain selected from the group consisting of: (i) mAb A[PD-1]_H1L1 (SEQ ID NOS:591 and 592), (ii) mAb B[PD-1]_H1L1 (SEQ ID NOS:593 and 594), (iii) mAb C[PD-1]_H1L1 (SEQ ID NOS595 and 596), and (iv) mAb C[PD-1]_H1.19L1 (SEQ ID NOS:569 and 567). In some embodiments, the scFv domain that binds human PD-1 and does not compete for the human PD-1 with nivolumab and/or pembrolizumab comprises: a variable heavy chain selected from the group consisting of: (a) mAb C[PD-1]_H1 (SEQ ID NO: 568), (b) mAb C[PD-1]_H1.19 (SEQ ID NO: 569), (c) mAb C[PD-1]_H1.48 (SEQ ID NO: 570), (d) mAb C[PD-1]_H1.125 (SEQ ID NO: 571), (e) mAb C[PD-1]_H1.130 (SEQ ID NO: 572), (f) mAb C[PD-1]_H1.132 (SEQ ID NO: 573), (g) mAb C[PD-1]_H1.169 (SEQ ID NO: 574), (h) mAb C[PD-1]_H1.175 (SEQ ID NO: 575), and (i) mAb C[PD-1]_H2 (SEQ ID NO: 576); and a variable light chain selected from the group consisting of: (a) mAb C[PD-1]_L1 (SEQ ID NO: 577), (b) mAb C[PD-1]_L1.1 (SEQ ID NO: 578), (c) mAb C[PD-1]_L1.3 (SEQ ID NO: 579), (d) mAb C[PD-1]_L1.45 (SEQ ID NO: 580), (e) mAb C[PD-1]_L1.117 (SEQ ID NO: 581), (f) mAb C[PD-1]_L1.129 (SEQ ID NO: 582), (g) mAb C[PD-1]_L1.135 (SEQ ID NO: 583), (h) mAb C[PD-1]_L1.136 (SEQ ID NO: 584), (i) mAb C[PD-1]_L1.140 (SEQ ID NO: 585), and (j) mAb C[PD-1]_L2 (SEQ ID NO: 586).

In certain embodiments of any one of the targeted IL-12-Fc fusion formats, the antigen binding domain that binds human PD-1 and does not compete for the human PD-1 with nivolumab and/or pembrolizumab comprises: a VH domain selected from the group consisting of: (a) mAb C[PD-1]_H1 (SEQ ID NO: 568), (b) mAb C[PD-1]_H1.19 (SEQ ID NO: 569), (c) mAb C[PD-1]_H1.48 (SEQ ID NO: 570), (d) mAb C[PD-1]_H1.125 (SEQ ID NO: 571), (e) mAb C[PD-1]_H1.130 (SEQ ID NO: 572), (f) mAb C[PD-1]_H1.132 (SEQ ID NO: 573), (g) mAb C[PD-1]_H1.169 (SEQ ID NO: 574), (h) mAb C[PD-1]_H1.175 (SEQ ID NO: 575), and (i) mAb C[PD-1]_H2 (SEQ ID NO: 576); and a VL domain selected from the group consisting of: (a) mAb C[PD-1]_L1 (SEQ ID NO: 577), (b) mAb C[PD-1]_L1.1 (SEQ ID NO: 578), (c) mAb C[PD-1]_L1.3 (SEQ ID NO: 579), (d) mAb C[PD-1]_L1.45 (SEQ ID NO: 580), (e) mAb C[PD-1]_ L1.117 (SEQ ID NO: 581), (f) mAb C[PD-1]_L1.129 (SEQ ID NO: 582), (g) mAb C[PD-1]_L1.135 (SEQ ID NO: 583), (h) mAb C[PD-1]_L1.136 (SEQ ID NO: 584), (i) mAb C[PD-1]_L1.140 (SEQ ID NO: 585), and (j) mAb C[PD-1]_ L2 (SEQ ID NO: 586).

In some embodiments of any one of the targeted IL-12-Fc fusion formats, the antigen binding domain that binds human PD-L1 comprises a VH domain and a VL domain selected from the group consisting of: (a) durvalumab (SEQ ID NOS: 597 and 598), (b) atezolizumab (SEQ ID NOS: 599 and 600), (c) A09-246-2 (SEQ ID NOS: 601 and 602), (d) 12A4 (SEQ ID NOS: 603 and 604), (e) 3G10 (SEQ ID NOS: 605 and 606), (f) 10A5 (SEQ ID NOS: 607 and 608), (f) h3D10 Var 1 (SEQ ID NOS: 609 and 610), (g) h3D10 Var 2 (SEQ ID NOS: 611 and 612), (h) h3D10 Var 3 (SEQ ID NOS: 613 and 614), (i) h3D10 Var 4 (SEQ ID NOS: 615 and 616), (j) h3D10 Var 5 (SEQ ID NOS: 617 and 618), (k) h3D10 Var 6 (SEQ ID NOS: 619 and 620), (l) h3D10 Var 7 (SEQ ID NOS: 621 and 622), (m) h3D10 Var 8 (SEQ ID NOS: 623 and 624), (n) h3D10 Var 9 (SEQ ID NOS: 625 and 626), (o) h3D10 Var 10 (SEQ ID NOS: 627 and 628), (p) h3D10 Var 11 (SEQ ID NOS: 629 and 630), (q) h3D10 Var 12 (SEQ ID NOS: 631 and 632), (r) h3D10 Var 13 (SEQ ID NOS: 633 and 634), (s) h3D10 Var 14 (SEQ ID NOS: 635 and 636), (t) Antibody A (SEQ ID NOS: 637 and 638), (u) C5H9v2 (SEQ ID NOS: 639 and 640), (v) humanized 29E.2A3 (SEQ ID NOS: 641 and 642), (w) 1B9 (SEQ ID NOS: 643 and 644), (x) 4H1 (SEQ ID NOS: 645 and 646), (y) mAb-42 (SEQ ID NOS: 647 and 648), (z) BAP058-03 (SEQ ID NOS: 649 and 650), (aa) BAP058-04 (SEQ ID NOS: 651 and 652), (ab) BAP058-06 (SEQ ID NOS: 653 and 654), (ac) BAP058-07 (SEQ ID NOS: 655 and 656), (ad) BAP058-11 (SEQ ID NOS: 657 and 658), (ae) BAP058-13 (SEQ ID NOS: 659 and 660), (af) H6 (SEQ ID NOS: 661 and 662), (ag) RC5 (SEQ ID NOS: 663 and 664), (ah) SH1A1Q (SEQ ID NOS: 665 and 666), (ai) SH1B3 (SEQ ID NOS: 667 and 668), (aj) SH1D1 (SEQ ID NOS: 669 and 670), (ak) SH1D2 (SEQ ID NOS: 671 and 672), (al) SH1D12 (SEQ ID NOS: 673 and 674), (am) SH1E1 (SEQ ID NOS: 675 and 676), (an) SH1G9 (SEQ ID NOS: 677 and 678), (ao) SH1E6 (SEQ ID NOS: 679 and 680), (ap) SH1A2 (SEQ ID NOS: 681 and 682), (aq) SH1B1 (SEQ ID NOS: 683 and 684), (ar) H6B1L (SEQ ID NOS: 685 and 686), (as) H6A1 (SEQ ID NOS: 687 and 688), (at) H6B1 (SEQ ID NOS: 689 and 690), (au) H6B2 (SEQ ID NOS: 691 and 692), (av) G12 (SEQ ID NOS: 693 and 694), (aw) RSA1 (SEQ ID NOS: 695 and 696), (ax) RA3 (SEQ ID NOS: 697 and 698), (ay) SH1E2 (SEQ ID NOS: 699 and 700), (az) SH1E4 (SEQ ID NOS: 701 and 702), (ba) SH1B1 (SEQ ID NOS: 683 and 684), (bb) SH1C8 (SEQ ID NOS: 705 and 706), (bc) H1H9364P2 (SEQ ID NOS: 707 and 708), (bd) H1H9373P2 (SEQ ID NOS: 709 and 710), (be) H1H8314N (SEQ ID NOS: 711 and 712), and (bf) PDL1.3 (SEQ ID NOS: 713 and 714).

In some embodiments of any one of the targeted IL-12-Fc fusion formats, the modifications promoting heterodimerization of the first and the second Fc domains are a set of amino acid substitutions selected from the group consisting of L368D/K370S and S364K; L368D/K370S and S364K/E357L; L368D/K370S and S364K/E357Q; T411E/K360E/Q362E and D401K; L368E/K370S and S364K; K370S and S364K/E357Q; T366S/L368A/Y407V and T366W; and T366S/L368A/Y407V/Y349C and T366W/S354C, according to EU numbering.

In some embodiments, the first and/or the second variant Fc domains have an additional set of amino acid substitutions comprising Q295E/N384D/Q418E/N421D, according to EU numbering. In some embodiments, the first variant Fc domain or the second variant Fc domain has an additional set of amino acid substitutions comprising Q295E/N384D/Q418E/N421D, according to EU numbering. In some embodiments, the first and the second variant Fc domains each have an additional set of amino acid substitutions comprising Q295E/N384D/Q418E/N421D, according to EU numbering.

In some embodiments of any one of the targeted IL-12-Fc fusion formats, the first and/or the second variant Fc domains have an additional set of amino acid substitutions consisting of G236R/L328R, E233P/L234V/L235A/G236del/S239K, E233P/L234V/L235A/G236del/S239K/A327G, E233P/L234V/L235A/G236del/S267K/A327G, E233P/L234V/L235A/G236del, and E233P/L234V/L235A/G236del/S267K, according to EU numbering. In some embodiments, the first variant Fc domain or the second variant Fc domain has an additional set of amino acid substitutions consisting of G236R/L328R, E233P/L234V/L235A/G236del/S239K, E233P/L234V/L235A/G236del/S239K/A327G, E233P/L234V/L235A/G236del/S267K/A327G, E233P/L234V/L235A/G236del, and E233P/L234V/L235A/G236del/S267K, according to EU numbering. In some embodiments, the first and the second variant Fc domains have an additional set of amino acid substitutions consisting of G236R/L328R, E233P/L234V/L235A/G236del/S239K, E233P/L234V/L235A/G236del/S239K/A327G, E233P/L234V/L235A/G236del/S267K/A327G, E233P/L234V/L235A/G236del, and E233P/L234V/L235A/G236del/S267K, according to EU numbering.

In some embodiments of any one of the targeted IL-12-Fc fusion formats, the first and the second variant Fc domains each comprise amino acid substitutions M428L/N434S, according to EU numbering.

In some embodiments of any one of the targeted IL-12-Fc fusion formats, the IL-12p40 subunit has a polypeptide sequence selected from the group consisting of SEQ ID NO:3 (human IL-12 subunit beta (IL-12p40) precursor sequence) and SEQ ID NO:4 (human IL-12 subunit beta (IL-12p40) mature form sequence), and the IL-12p35 subunit has a polypeptide sequence selected from the group consisting of SEQ ID NO:1 (human IL-12 subunit alpha (IL-12p35) precursor sequence) and SEQ ID NO:2 (human IL-12 subunit alpha (IL-12p35) mature form sequence). In some embodiments, the IL-12p40 subunit is a variant IL-12p40 subunit and/or the IL-12p35 subunit is a variant IL-12p35 subunit.

In some embodiments of any one of the targeted IL-12-Fc fusion formats, the IL-12p40 subunit is a variant IL-12p40 subunit having altered affinity for IL-12 receptor subunit beta-1 (IL-12R(31), IL-12 receptor subunit beta-2 (IL-12R (32), and/or IL-12 receptor complex; and/or the IL-1p35 subunit is a variant IL-12p35 subunit having altered affinity for IL-12 receptor subunit beta-1 (IL-12R(31), IL-12 receptor subunit beta-2 (IL-12R(32), and/or IL-12 receptor complex.

In some embodiments of any one of the targeted IL-12-Fc fusion formats, the IL-12p40 subunit is a variant IL-12p40 subunit having altered affinity for IL-12 receptor subunit beta-1 (IL-12R(31), IL-12 receptor subunit beta-2 (IL-12R (32), and/or IL-12 receptor complex. In some embodiments, the IL-12p35 subunit is a variant IL-12p35 subunit having altered affinity for IL-12 receptor subunit beta-1 (IL-12R (31), IL-12 receptor subunit beta-2 (IL-12R(32), and/or IL-12 receptor complex.

In some embodiments of any one of the targeted IL-12-Fc fusion formats, the IL-12p40 subunit has one or more amino acid substitutions at amino acid residues selected from the group consisting of E59, K99, D18, K264, C252, N200, E3, D7, E12, D14, W15, P17, A19, P20, G21, E22, M23, D29, E32, E33, D34, L40, D41, Q42, S43, E45, L47, T54, I55, Q56, K58, F60, G61, D62, Q65, Y66, E73, K84, E86, D87, G88, I89, W90, D93, D97, E100, K102, N103, K104, F106, E110, N113, Y114, D129, D142, Q144, E156, R159, D161, N162, K163, D166, D170, Q172, D174, A176, C177, P178, A179, A180, E181, S183, P185, E187, S204, F206, R208, D209, D214, N218, Q220, N226, Q229, E231, E235, T242, P243, S245, Y246, F247, S248, Q256, K258, K260, E262, D265, D270, N281, Q289, D290, R291, Y292, Y293, and E299.

In certain embodiments of any one of the targeted IL-12-Fc fusion formats, the IL-12p40 subunit has one or more amino acid substitutions selected from the group consisting of E59K, K99E, K99Y, D18K, K264E, C252S, N200Q, D18N, E32Q, E33Q, D34K, D34N, Q42E, S43E, S43K, E45Q, Q56E, E59Q, D62N, E73Q, D87N, E100Q, N103D, N103Q, N113D, N113Q, Q144E, R159E, D161N, K163E, E187Q, N200D, N218Q, Q229E, E235Q, Q256N, K258E, K260E, E262Q, N281D, N281Q, and E299Q.

In some embodiments, the IL-12p40 subunit or variant IL-12p40 subunit comprises amino acid substitutions selected from the group consisting of E59K/K99E, E59K/ K99Y, D18K/E59K/K99E, E59K/K99E/K264E, D18K/ E59K/K99E/K264E, E59K/K99E/C252S, E59K/K99Y/ C252S, D18K/E59K/K99E/C252S, E59K/K99E/C252S/ K264E, D18K/E59K/K99E/C252S/K264E, E59K/K99E/ N200Q, E59K/K99Y/N200Q, D18K/E59K/K99E/N200Q, E59K/K99E/N200Q/K264E, D18K/E59K/K99E/N200Q/ K264E, E59K/K99E/N200Q/C252S, E59K/K99Y/N200Q/ C252S, D18K/E59K/K99E/N200Q/C252S, E59K/K99E/ N200Q/C252S/K264E, and D18K/E59K/K99E/N200Q/ C252S/K264E.

In some embodiments, the IL-12p40 subunit has amino acid substitutions selected from the group consisting of: E59K/K99E, E59K/K99Y, D18K/E59K/K99E, E59K/ K99E/K264E, D18K/E59K/K99E/K264E, E59K/K99E/ C252S, E59K/K99Y/C252S, D18K/E59K/K99E/C252S, E59K/K99E/C252S/K264E, D18K/E59K/K99E/C252S/ K264E, E59K/K99E/N200Q, E59K/K99Y/N200Q, D18K/ E59K/K99E/N200Q, E59K/K99E/N200Q/K264E, D18K/ E59K/K99E/N200Q/K264E, E59K/K99E/N200Q/C252S, E59K/K99Y/N200Q/C252S, D18K/E59K/K99E/N200Q/ C252S, E59K/K99E/N200Q/C252S/K264E, D18K/E59K/ K99E/N200Q/C252S/K264E, D18K/E59K/K99E/C252S, E32K/D34N/E59K/K99E, E32Q/D34N/E59K/K99E, D34K/E59K/K99E, D34N/E59K, D34N/E59K/K99E, Q42E/E45Q, Q42E/E59Q, Q42E/Q56E/E59Q, E32Q/E59Q, D34N/E59Q, S43E/E59Q, S43K/E49Q, E45K/E59K/K99E, E45Q/Q56E, E45Q/Q56E/E59Q, E59Q/E187Q, E59Q/ K163E, E59Q/K99E, E59Q/K258E, E59Q/K260E, E59K/ K99E/N103Q/C252S/K264E, E59K/K99E/Q144E, E59K/ K99E/Q144K, E59K/K99E/R159E, E59K/K99Y, E59Y/ K99E, E59Y/K99Y, E59K/K99E/N113Q/C252S/K264E, E59K/K99E/N281Q/C252S/K264E, E59K/K99E/N103Q/ N113Q/C252S/K264E, E59K/K99E/N103Q/N200Q/ C252S/K264E, E59K/K99E/N103Q/N281Q/C252S/ K264E, E59K/K99E/N113Q/N200Q/C252S/K264E, E59K/ K99E/N113Q/N281Q/C252S/K264E, E59K/K99E/N200Q/ N281Q/C252S/K264E, E59K/K99E/N103Q/N113Q/ N200Q/C252S/K264E, E59K/K99E/N103Q/N200Q/ N281Q/C252S/K264E, E59K/K99E/N113Q/N200Q/ N281Q/C252S/K264E, E59K/K99E/N103Q/N113Q/ N200Q/N281Q/C252S/K264E, N103D/N113D, N103D/ N113D/N200D, N103D/N113D/N281D, N103D/N200D, N103D/N200D/N281D, N103D/N281D, N103D/N113D/ N200D/N281D, N103Q/N113Q, N103Q/N113Q/N200Q, N103Q/N113Q/N281Q, N103Q/N200Q, N103Q/N200Q/ N281Q, N103Q/N281Q, N113D/N200D, N113D/N200D/ N281D, N113D/N281D, N113Q/N200Q, N113Q/N281Q, N113Q/N200Q/N281Q, N103Q/N113Q/N200Q/N281Q, N200D/N281D, and N200Q/N281Q.

In certain embodiments of any one of the targeted IL-12-Fc fusion formats, the IL-12p40 subunit has a polypeptide sequence selected from the group consisting of: i) SEQ ID NO:57 (IL-12p40(N103D)), ii) SEQ ID NO:58 (IL-12p40 (N113D)), iii) SEQ ID NO:59 (IL-12p40(N200D)), iv) SEQ ID NO:60 (IL-12p40(N281D)), v) SEQ ID NO:61 (IL-12p40(N103D/N113D/N200D/N281D)), vi) SEQ ID NO:62 (IL-12p40(Q42E)), vii) SEQ ID NO:63 (IL-12p40(E45Q)), viii) SEQ ID NO:64 (IL-12p40(Q56E)), ix) SEQ ID NO:65 (IL-12p40(E59Q)), x) SEQ ID NO:66 (IL-12p40(D62N)), xi) SEQ ID NO:67 (IL-12p40(Q42E/E45Q)), xii) SEQ ID NO:68 (IL-12p40(E45Q/Q56E)), xiii) SEQ ID NO:69 (IL-12p40(Q42E/E59Q)), xiv) SEQ ID NO:70 (IL-12p40 (Q56E/E59Q)), xv) SEQ ID NO:71 (IL-12p40(Q42E/E45Q/ Q56E)), xvi) SEQ ID NO:72 (IL-12p40(E45Q/Q56E/ E59Q)), xvii) SEQ ID NO:73 (IL-12p40(D161N)), xviii) SEQ ID NO:74 (IL-12p40(E73Q)), xix) SEQ ID NO:75 (IL-12p40(Q144E)), xx) SEQ ID NO:76 (IL-12p40 (E262Q)), xxi) SEQ ID NO:77 (IL-12p40(E100Q)), xxii) SEQ ID NO:78 (IL-12p40(D18N)), xxiii) SEQ ID NO:79 (IL-12p40(E33Q)), xxiv) SEQ ID NO:80 (IL-12p40 (Q229E)), xxv) SEQ ID NO:81 (IL-12p40(E235Q)), xxvi) SEQ ID NO:82 (IL-12p40(Q256N)), xxvii) SEQ ID NO:83 (IL-12p40(E299Q)), xxviii) SEQ ID NO:84 (IL-12p40 (D87N)), xxix) IL-12p40(E32Q), xxx) IL-12p40(D34N), xxxi) IL-12p40(S43E), xxxii) IL-12p40(S43K), xxxiii) SEQ ID NO:379 (IL-12p40 (E59K/K99E/N103Q/N113Q/ N200Q/N281Q/C252S/K264E)), xxxiv) SEQ ID NO:205 (IL-12p40(E59K)), xxxv) IL-12p40(K99E), xxxvi) IL-12p40(K163E), xxxvii) IL-12p40(E187Q), xxxviii) IL-12p40(K258E), xxxix) IL-12p40(K260E), xl) SEQ ID NO:206 (IL-12p40(E32Q/E59Q)), xli) SEQ ID NO:207 (IL-12p40(D34N/E59Q)), xlii) SEQ ID NO:208 (IL-12p40 (E59Q/E187Q)), xliii) SEQ ID NO:209 (IL-12p40(S43E/ E59Q)), xliv) SEQ ID NO:210 (IL-12p40(S43K/E59Q)), xlv) SEQ ID NO:211 (IL-12p40(E59Q/K163E)), xlvi) SEQ ID NO:212 (IL-12p40(E59Q/K99E)), xlvii) SEQ ID NO:213 (IL-12p40(E59Q/K258E)), xlviii) SEQ ID NO:214 (IL-12p40(E59Q/K260E)), xlix) SEQ ID NO: 326 (IL-12p40 (D34N/E59K)) l) SEQ ID NO: 325 (IL-12p40(E59K/ K99E)), li) SEQ ID NO: 339 (IL-12p40(D18K/E59K/ K99E)), lii) SEQ ID NO: 343 (IL-12p40 (E59K/K99E/ K264E)), liii) SEQ ID NO: 336 (IL-12p40 (E59K/K99Y)), liv) SEQ ID NO: 335 (IL-12p40 (E59Y/K99E)), lv) SEQ ID NO: 338 (IL-12p40 (E45K/E59K/K99E)), lvi) SEQ ID NO: 340 (IL-12p40 (E59K/K99E/Q144E)), lvii) SEQ ID NO: 341 (IL-12p40 (E59K/K99E/Q144K)), lviii) SEQ ID NO: 342 (IL-12p40 (E59K/K99E/R159E)), lix) SEQ ID NO: 343 (IL-12p40 (E59K/K99E/K264E)), lx) SEQ ID NO: 344 (IL-12p40 (D18K/E59K/K99E/K264E)), lxi) SEQ ID NO: 360 (IL-12p40 (C252S)), lxii) SEQ ID NO: 361 (IL-12p40 (D18K/E59K/K99E/C252S)), lxiii) SEQ ID NO: 362 (IL-12p40 (D18K/E59K/K99E/C252S/K264E)), lxiv) SEQ ID NO: 363 (IL-12p40 (E59K/K99Y/C252S)), lxv) SEQ ID NO: 364 (IL-12p40 (E59K/K99E/C252S/K264E)), lxvi) SEQ ID NO: 365 (IL-12p40 (E59K/K99E/C252S)), lxvii) SEQ ID NO: 254 (IL-12p40 (N103D/N113D)), lxviii) SEQ ID NO: 255 (IL-12p40 (N103D/N200D)), lxix) SEQ ID NO: 256 (IL-12p40 (N103D/N281D)), lxx) SEQ ID NO: 257 (IL-12p40 (N113D/N200D)), lxxi) SEQ ID NO: 258 (IL-12p40 (N113D/N281D)), lxxii) SEQ ID NO: 259 (IL-12p40 (N200D/N281D)), lxxiii) SEQ ID NO: 260 (IL-12p40 (N103D/N113D/N200D)), lxxiv) SEQ ID NO: 261 (IL-12p40 (N103D/N113D/N281D)), lxxv) SEQ ID NO: 262 (IL-12p40 (N103D/N200D/N281D)), lxxvi) SEQ ID NO: 263 (IL-12p40 (N113D/N200D/N281D)), lxxvii) SEQ ID NO: 264 (IL-12p40 (N103Q)), lxxviii) SEQ ID NO: 265 (IL-12p40 (N113Q)), lxxix) SEQ ID NO: 266 (IL-12p40 (N200Q)), lxxx) SEQ ID NO: 267 (IL-12p40 (N281Q)), lxxxi) SEQ ID NO: 268 (IL-12p40 (N103Q/N113Q)), lxxxii) SEQ ID NO: 269 (IL-12p40 (N103Q/N200Q)), lxxxiii) SEQ ID NO: 270 (IL-12p40 (N103Q/N281Q)), lxxxiv) SEQ ID NO: 271 (IL-12p40 (N113Q/N200Q)), lxxxv) SEQ ID NO: 272 (IL-12p40 (N113Q/N281Q)), lxxxvi) SEQ ID NO: 273 (IL-12p40 (N200Q/N281Q)), lxxxvii) SEQ ID NO: 274 (IL-12p40 (N103Q/N113Q/N200Q)), lxxxviii) SEQ ID NO: 275 (IL-12p40 (N103Q/N113Q/N281Q)), lxxxix) SEQ ID NO: 276 (IL-12p40 (N103Q/N200Q/N281Q)), xc) SEQ ID NO: 277 (IL-12p40 (N113Q/N200Q/N281Q)), xci) SEQ ID NO:278 (IL-12p40 (N103Q/N113Q/N200Q/N281Q)), xcii) SEQ ID NO:327 (IL-12p40 (D34N/E59K/K99E)), xciii) SEQ ID NO:328 (IL-12p40 (D34K/E59K/K99E)), xciv) SEQ ID NO:329 (IL-12p40 (E32Q/D34N/E59K/K99E)), xcv) SEQ ID NO:331 (IL-12p40 (E32K/D34N/E59K/K99E)), xcvi) SEQ ID NO: 337 (IL-12p40 (E59Y/K99Y)), xcvii) SEQ ID NO:366 (IL-12p40 (E59K/K99E/N103Q/C252S/K264E)), xcviii) SEQ ID NO:367 (IL-12p40 (E59K/K99E/N113Q/C252S/K264E)), xcix) SEQ ID NO:368 (IL-12p40 (E59K/K99E/N200Q/C252S/K264E)), c) SEQ ID NO:369 (IL-12p40 (E59K/K99E/N281Q/C252S/K264E)), ci) SEQ ID NO:370 (IL-12p40 (E59K/K99E/N103Q/N113Q/C252S/K264E)), cii) SEQ ID NO:371 (IL-12p40 (E59K/K99E/N103Q/N200Q/C252S/K264E)), ciii) SEQ ID NO:372 (IL-12p40 (E59K/K99E/N103Q/N281Q/C252S/K264E)), civ) SEQ ID NO:373 (IL-12p40 (E59K/K99E/N113Q/N200Q/C252S/K264E)), cv) SEQ ID NO:374 (IL-12p40 (E59K/K99E/N113Q/N281Q/C252S/K264E)), cvi) SEQ ID NO:375 (IL-12p40 (E59K/K99E/N200Q/N281Q/C252S/K264E)), cvii) SEQ ID NO:376 (IL-12p40 (E59K/K99E/N103Q/N113Q/N200Q/C252S/K264E)), cviii) SEQ ID NO:377 (IL-12p40 (E59K/K99E/N103Q/N200Q/N281Q/C252S/K264E)), and cix) SEQ ID NO:378 (IL-12p40 (E59K/K99E/N113Q/N200Q/N281Q/C252S/K264E)).

In some embodiments of any one of the targeted IL-12-Fc fusion formats, the IL-12p35 subunit has one or more amino acid substitutions as amino acid residues selected from the group consisting of Q20, N21, Q35, E38, S44, E45, E46, H49, K54, D55, T59, V60, E61, C63, L64, P65, E67, L68, N71, S73, C74, L75, N76, E79, N85, L89, F96, M97, L124, M125, Q130, Q135, N136, E143, Q146, N151, E153, K158, E162, E163, D165, I171, R181, I182, R183, V185, T186, D188, R189, V190, S192, Y193, N195, and A196. In certain embodiments, the IL-12p35 subunit has one or more amino acid substitutions selected from the group consisting of N21D, Q35D, E38Q, D55Q, D55K, N71D, N71Q, L75A, N76D, E79Q, N85D, N85Q, L89A, F96A, M97A, L124A, M125A, Q130E, Q135E, N136D, E143Q, Q146E, N151D, N151K, E153K, E153Q, K158E, E162Q, E163Q, D165N, I171A, N195D, and N195Q. In some embodiments, the IL-12p35 subunit has one or more amino acid substitutions selected from the group consisting of N21D/N151D, D55Q/N151D, N71D/N85D, N71D/N85D/N195D, N71D/N195D, N71Q/N85Q, N71Q/N85Q/N195Q, N71Q/N195Q, E79Q/N151D, N85D/N195D, N85Q/N195Q, Q130E/N151D, N136D/N151D, E143Q/N151D, N151D/E153Q, N151D/D165N, and N151D/K158E.

In some embodiments of any one of the targeted IL-12-Fc fusion formats, the IL-12p35 subunit has one or more amino acid substitutions selected from the group consisting of: i) SEQ ID NO:113 (IL-12p35(N71D)), ii) SEQ ID NO:114 (IL-12p35(N85D)), iii) SEQ ID NO:115 (IL-12p35 (N195D)), iv) SEQ ID NO:116 (IL-12p35(N71D/N85D/N195D)), v) SEQ ID NO:117 (IL-12p35(E153Q)), vi) SEQ ID NO:118 (IL-12p35(E38Q)), vii) SEQ ID NO:119 (IL-12p35(N151D)), viii) SEQ ID NO:120 (IL-12p35(Q135E)), ix) SEQ ID NO:121 (IL-12p35(Q35D)), x) SEQ ID NO:122 (IL-12p35(Q146E)), xi) SEQ ID NO:123 (IL-12p35 (N76D)), xii) SEQ ID NO:124 (IL-12p35(E162Q)), xiii) SEQ ID NO:125 (IL-12p35(E163Q)), xiv) IL-12p35 (N21D), xv) SEQ ID NO:333 (IL-12p35(D55Q)), xvi) IL-12p35(E79Q), xvii) IL-12p35(Q130E), xviii) IL-12p35 (N136D), xix) IL-12p35(E143Q), xx) SEQ ID NO:227 (IL-12p35(N151K)), xxi) SEQ ID NO:226 (IL-12p35 (E153K)), xxii) IL-12p35(K158E), xxiii) IL-12p35 (D165N), xxiv) SEQ ID NO:225 (IL-12p35(N151D/E153Q)), xxv) SEQ ID NO:228 (IL-12p35(N151D/D165N)), xxvi) SEQ ID NO:229 (IL-12p35(Q130E/N151D)), xxvii) SEQ ID NO:230 (IL-12p35(N151D/K158E)), xxviii) SEQ ID NO:231 (IL-12p35(E79Q/N151D)), xxix) SEQ ID NO:232 (IL-12p35(D55Q/N151D)), xxx) SEQ ID NO:233 (IL-12p35(N136D/N151D)), xxxi) SEQ ID NO:234 (IL-12p35(N21D/N151D)), xxxii) SEQ ID NO:235 (IL-12p35(E143Q/N151D)), xxxiii) SEQ ID NO: 345 (IL-12p35(F96A)), xxxiv) SEQ ID NO: 346 (IL-12p35(M97A)), xxxv) SEQ ID NO: 347 (IL-12p35(L89A)), xxxvi) SEQ ID NO: 348 (IL-12p35(L124A)), xxxvii) SEQ ID NO: 349 (IL-12p35 (M125A)), xxxviii) SEQ ID NO: 350 (IL-12p35(L75A)), xxxiv) SEQ ID NO: 351 (IL-12p35(I171A)), xxxv) SEQ ID NO: 279 (IL-12p35 (N71Q)), xxxvi) SEQ ID NO: 280 (IL-12p35 (N85Q)), xxxvii) SEQ ID NO: 281 (IL-12p35 (N195Q)), xxxviii) SEQ ID NO: 282 (IL-12p35 (N71Q/N85Q)), xxxix) SEQ ID NO: 283 (IL-12p35 (N71Q/N195Q)), xl) SEQ ID NO: 284 (IL-12p35 (N85Q/N195Q), xli) SEQ ID NO: 285 (IL-12p35 (N71Q/N85Q/N195Q)), xlii) SEQ ID NO: 286 (IL-12p35 (N71D/N85D)), xliii) SEQ ID NO: 287 (IL-12p35 (N71D/N195D)), xliv) SEQ ID NO: 288 (IL-12p35 (N85D/N195D)), xlv) SEQ ID NO: 333 (IL-12p35 (D55Q)), and xlvi) SEQ ID NO: 334 (IL-12p35 (D55K)).

In one aspect, provided is a composition comprising any of the targeted IL-12 heterodimeric Fc fusion proteins described herein for use in treating cancer in a subject.

In another aspect, provided are one or more nucleic acids encoding any one of the targeted IL-12 heterodimeric Fc fusion proteins described herein. In some aspects, provided herein is a host cell comprising any one or more nucleic acids described.

In another aspect, disclosed herein is a method of making a targeted IL-12 heterodimeric Fc fusion protein, such that the method comprises culturing any one of the host cells provided herein under conditions, whereby the targeted IL-12 heterodimeric Fc fusion protein is produced.

In certain aspects, disclosed herein is a method of purifying a targeted IL-12 heterodimeric Fc fusion protein described herein. The method comprises: (a) providing a composition comprising any one of the targeted IL-12 heterodimeric Fc fusion proteins described herein; (b) loading the composition onto an ion exchange column; and (c) collecting a fraction containing the targeted IL-12 heterodimeric Fc fusion protein.

In another aspect, the present invention provides a method of treating cancer in a patient in need thereof. The method comprises administering a therapeutically effective amount of a targeted IL-12 heterodimeric Fc fusion protein according to any of the illustrative embodiments provided herein to the patient. In some embodiments, the method further comprises administering a therapeutically effective amount of a checkpoint blockade antibody. In some embodiments, the checkpoint blockade antibody is selected from an anti-PD-1 antibody, an anti-PD-L1 antibody, an anti-TIM3 antibody, an anti-TIGIT antibody, an anti-LAG3 antibody, and an anti-CTLA-4 antibody. In some embodiments, the anti-PD-1 antibody is nivolumab, pembrolizumab, or pidilizumab. In some embodiments, the anti-PD-L1 antibody is atezolizumab, avelumab, or durbalumab. In some embodiments, the patient exhibits an increase in lymphocytes following administration. In some embodiments, the patient exhibits an increase in peripheral CD8+ T cells following administration.

In another aspect, the present invention provides a method of inducing T cell expansion in a patient in need thereof comprising administering a therapeutically effective amount of targeted IL-12 heterodimeric Fc fusion protein according to any of the illustrative embodiments provided herein to the patient. In some embodiments, the method further comprises administering a therapeutically effective amount of a checkpoint blockade antibody. In some embodiments, the checkpoint blockade antibody is selected from an anti-PD-1 antibody, an anti-PD-L1 antibody, an anti-TIM3 antibody, an anti-TIGIT antibody, an anti-LAG3 antibody, and an anti-CTLA-4 antibody. In some embodiments, the anti-PD-1 antibody is nivolumab, pembrolizumab, or pidilizumab. In some embodiments, the anti-PD-L1 antibody is atezolizumab, avelumab, or durbalumab. In some embodiments, the T cell expansion is at least a 2-fold increase in T cells. In some embodiments, the targeted IL-12 heterodimeric Fc fusion protein is administered before the checkpoint inhibitor is administered. In some embodiments, targeted IL-12 heterodimeric Fc fusion protein is administered after the checkpoint inhibitor is administered.

BRIEF DESCRIPTION OF THE DRAWINGS

FIG. 1A and FIG. 1B depict the sequences for IL-12 and its receptors.

FIG. 2A-FIG. 2E depict useful pairs of Fc heterodimerization variant sets (including skew and pI variants). Variants without a corresponding "monomer 2" are pI variants which can be used alone on either monomer.

FIG. 3 depicts a list of isosteric variant antibody constant regions and their respective substitutions. pI_(−) indicates lower pI variants, while pI_(+) indicates higher pI variants. These can be optionally and independently combined with other heterodimerization variants of the inventions (and other variant types as well, as outlined herein.)

FIG. 4 depicts useful ablation variants that ablate FcγR binding (sometimes referred to as "knock outs" or "KO" variants). Generally, ablation variants are found on both monomers, although in some cases they may be on only one monomer.

FIG. 5 shows particularly useful embodiments of "non-cytokine" components of the invention.

FIG. 6 depicts a number of exemplary domain linkers. In some embodiments, these linkers find use linking the IL-12p35 subunit, the IL-12p40 subunit, or the single-chain IL-12 complex to the N-terminus of the Fc region. In some embodiments, these linkers find use fusing IL-12p35 subunit to the IL-12p40 subunit in the single-chain IL-12 complex. It is important to note that the scIL-12 complex can comprise either IL-12p35 N-terminally linked to IL-12p40 or IL-12p40 N-terminally linked to IL-12p35. Also, in some cases as described herein, the hinge portion of an Fc domain serves as a domain linker, which can be combined with any of these linkers as well.

FIG. 7 depict a number of charged scFv linkers that find use in increasing or decreasing the pI of heterodimeric antibodies that utilize one or more scFv as a component. The (+H) positive linker finds particular use herein. A single prior art scFv linker with single charge is referenced as "Whitlow", from Whitlow et al., Protein Engineering 6(8): 989-995 (1993). It should be noted that this linker was used for reducing aggregation and enhancing proteolytic stability in scFvs.

FIG. 8A-8D shows the sequences of several useful IL-12-Fc fusion backbones based on human IgG1, without the cytokine sequences (e.g. the IL-12p35 subunit, the IL-12p40 subunit, or the scIL-12 complex). Backbone 1 is based on human IgG1 (356E/358M allotype), and includes C220S on both chains, the S364K/E357Q:L368D/K370S skew variants, the Q295E/N384D/Q418E/N421D pI variants on the chain with L368D/K370S skew variants and the E233P/L234V/L235A/G236del/S267K ablation variants on both chains. Backbone 2 is based on human IgG1 (356E/358M allotype), and includes C220S on both chains, the S364K:L368D/K370S skew variants, the Q295E/N384D/Q418E/N421D pI variants on the chain with L368D/K370S skew variants and the E233P/L234V/L235A/G236del/S267K ablation variants on both chains. Backbone 3 is based on human IgG1 (356E/358M allotype), and includes C220S on both chains, the S364K:L368E/K370S skew variants, the Q295E/N384D/Q418E/N421D pI variants on the chain with L368E/K370S skew variants and the E233P/L234V/L235A/G236del/S267K ablation variants on both chains. Backbone 4 is based on human IgG1 (356E/358M allotype), and includes C220S on both chains, the D401K: K360E/Q362E/T411E skew variants, the Q295E/N384D/Q418E/N421D pI variants on the chain with K360E/Q362E/T411E skew variants and the E233P/L234V/L235A/G236del/S267K ablation variants on both chains. Backbone 5 is based on human IgG1 (356D/358L allotype), and includes C220S on both chains, the S364K/E357Q:L368D/K370S skew variants, the Q295E/N384D/Q418E/N421D pI variants on the chain with L368D/K370S skew variants and the E233P/L234V/L235A/G236del/S267K ablation variants on both chains. Backbone 6 is based on human IgG1 (356E/358M allotype), and includes C220S on both chains, the S364K/E357Q:L368D/K370S skew variants, Q295E/N384D/Q418E/N421D pI variants on the chain with L368D/K370S skew variants and the E233P/L234V/L235A/G236del/S267K ablation variants on both chains, as well as an N297A variant on both chains. Backbone 7 is identical to 6 except the mutation is N297S. Alternative formats for backbones 6 and 7 can exclude the ablation variants E233P/L234V/L235A/G236del/S267K in both chains. Backbone 8 is based on human IgG4, and includes the S364K/E357Q:L368D/K370S skew variants, the Q295E/N384D/Q418E/N421D pI variants on the chain with L368D/K370S skew variants, as well as a S228P (EU numbering, this is S241P in Kabat) variant on both chains that ablates Fab arm exchange as is known in the art. Backbone 9 is based on human IgG2, and includes the S364K/E357Q:L368D/K370S skew variants, the Q295E/N384D/Q418E/N421D pI variants on the chain with L368D/K370S skew variants. Backbone 10 is based on human IgG2, and includes the S364K/E357Q:L368D/K370S skew variants, the Q295E/N384D/Q418E/N421D pI variants on the chain with L368D/K370S skew variants as well as a S267K variant on both chains. Backbone 11 is identical to backbone 1, except it includes M428L/N434S Xtend mutations. Backbone 12 is based on human IgG1 (356E/358M allotype), and includes C220S on both identical chain, the the E233P/L234V/L235A/G236del/S267K ablation variants on both identical chains. Backbone 13 is based on human IgG1 (356E/358M allotype), and includes C220S on both chain, the S364K/E357Q:L368D/K370S skew variants, the P217R/P229R/N276K pI variants on the chain with S364K/E357Q skew variants and the E233P/L234V/L235A/G236del/S267K ablation variants on both chains.

Figure 9A:
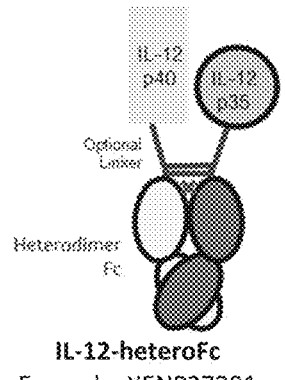

As will be appreciated by those in the art and outlined below, these sequences can be used with any IL-12-Fc fusion formats outlined herein, including but not limited to IL-12-heteroFc, heteroFc-IL-12, and scIL-12-Fc formats as schematically depicted in FIG. 9. It should be noted that for heteroFc-IL-12 fusions, the backbones may further comprise deletion of K447. Additionally, any IL-12p35 and/or IL-12p40 variants can be incorporated into these FIG. 7 backbones in any combination.

Included within each of these backbones are sequences that are 90, 95, 98 and 99% identical (as defined herein) to the recited sequences, and/or contain from 1, 2, 3, 4, 5, 6, 7, 8, 9 or 10 additional amino acid substitutions (as compared to the "parent" of the Figure, which, as will be appreciated by those in the art, already contain a number of amino acid modifications as compared to the parental human IgG1 (or IgG2 or IgG4, depending on the backbone). That is, the recited backbones may contain additional amino acid modifications (generally amino acid substitutions) in addition to the skew, pI and ablation variants contained within the backbones of this figure.

FIGS. 9A-9F depict illustrative formats for the IL-12-Fc fusion proteins of the present invention. The N-terminal IL-12 heterodimeric Fc fusion or "IL-12-heteroFc" (FIG. 9A) format comprises the IL-12p40 subunit recombinantly fused to the N-terminus of one side of a heterodimeric Fc and the IL-12p35 subunit recombinantly fused to N-terminus of the other side of the heterodimeric Fc. The IL-12p35 and IL-12p40 subunits may be linked to their respective Fc chains by a domain linker. The C-terminal IL-12 heterodimeric Fc fusion or "heteroFc-IL-12" (FIG. 9B) format comprises the IL-12p40 subunit recombinantly fused to the C-terminus of one side of a heterodimeric Fc and the IL-12p35 subunit recombinantly fused to the C-terminus of the other side of the heterodimeric Fc. The IL-12p35 and IL-12p40 subunits may be linked to their respective Fc chains by a domain linker. The N-terminal single-chain IL-12-Fc fusion or "scIL-12-Fc" (FIGS. 9C-9D) format comprises a single-chain IL-12 complex (or "scIL-12 complex") recombinantly fused to the N-terminus of one side of a heterodimeric Fc (optionally via a domain linker), with the other side of the molecule being a "Fc-only" or "empty-Fc" heterodimeric Fc. The C-terminal single-chain IL-12-Fc fusion or "Fc-scIL-12" (FIGS. 9E-9F) format comprises a scIL-12 complex recombinantly fused to the C-terminus of one side of a heterodimeric Fc (optionally via a domain linker), with the other side of the molecule being a "Fc-only" or "empty-Fc" heterodimeric Fc. The scIL-12 complex can comprise either IL-12p35 N-terminally linked to IL-12p40 or IL-12p40 N-terminally linked to IL-12p35, optionally but generally with a domain linker. The order of the two subunits in the scIL-12 complex may be designated as follows: "scIL-12(p40/p35)", wherein the IL-12p40 subunit is N-terminally linked to the IL-12p35 subunit, or "scIL-12(p35/p40)", wherein the IL-12p35 is N-terminally linked to the IL-12p40 subunit.

FIG. 10 depicts the sequences of XENP27201, an illustrative IL-12-Fc fusion protein of the "IL-12-heteroFc" format, that contains the wildtype IL-12p40 and wildtype IL-12p35 sequences. Linkers are double underlined (although as will be appreciated by those in the art, the linkers can be replaced by other linkers, some of which are depicted in FIG. 6), and slashes (/) indicate the border(s) between IL-12p35, IL-12p40, linkers, and Fc regions.

FIG. 11 depicts the sequences of XENP27202, an illustrative IL-12-Fc fusion protein of the "heteroFc-IL-12" format, that contains the wildtype IL-12p40 and wildtype IL-12p35 sequences. Linkers are double underlined (although as will be appreciated by those in the art, the linkers can be replaced by other linkers, some of which are depicted in FIG. 6), and slashes (/) indicate the border(s) between IL-12p35, IL-12p40, linkers, and Fc regions.

FIG. 12 depicts the sequences of XENP27203 and XENP27204, illustrative IL-12-Fc fusion proteins of the "scIL-12-Fc" format, that contains the wildtype IL-12p40 and wildtype IL-12p35 sequences. Linkers are double underlined (although as will be appreciated by those in the art, the linkers can be replaced by other linkers, some of which are depicted in FIG. 6), and slashes (/) indicate the border(s) between IL-12p35, IL-12p40, linkers, and Fc regions.

FIG. 13A-FIG. 13C depicts A) chromatogram illustrating purification part 2 of XENP27201 (anion exchange chromatography following protein A chromatography), and the purity and homogeneity of peak B isolated from anion exchange separation as depicted in FIG. 13A in comparison to peak A as determined by B) analytical size-exclusion chromatography with multi-angle light scattering (aSEC-MALS) and C) analytical anion exchange chromatography (analytical AIEX). FIG. 13B also depicts the molecular weight of protein species in peaks as determined by multi-angle light scattering.

Figure 14A:
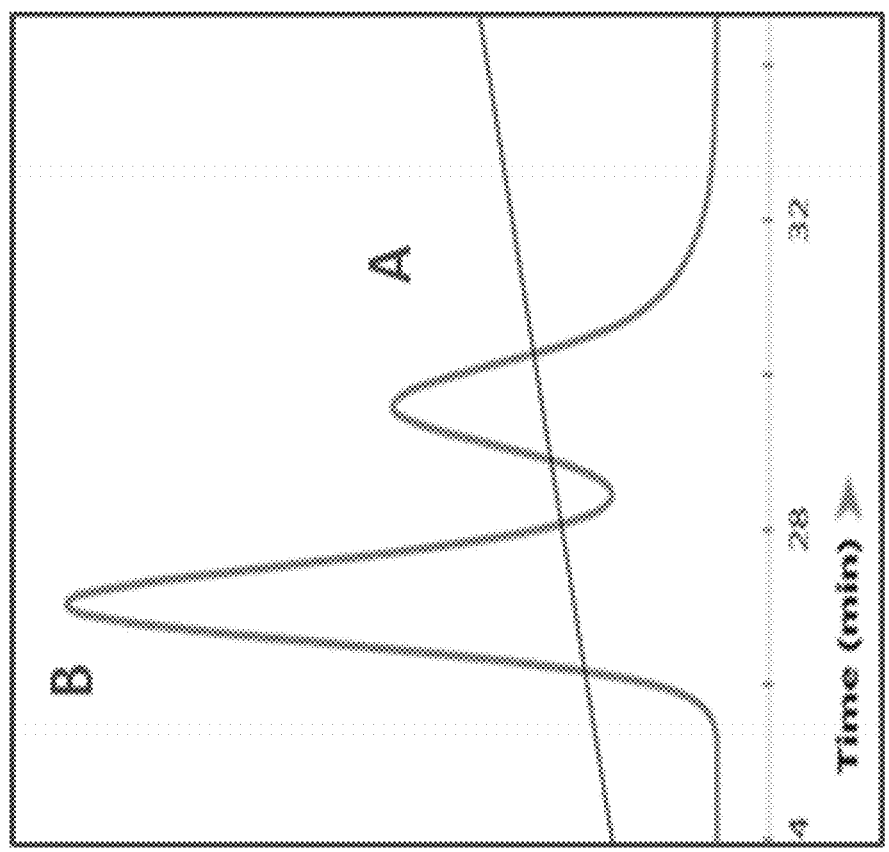
Figure 14B:
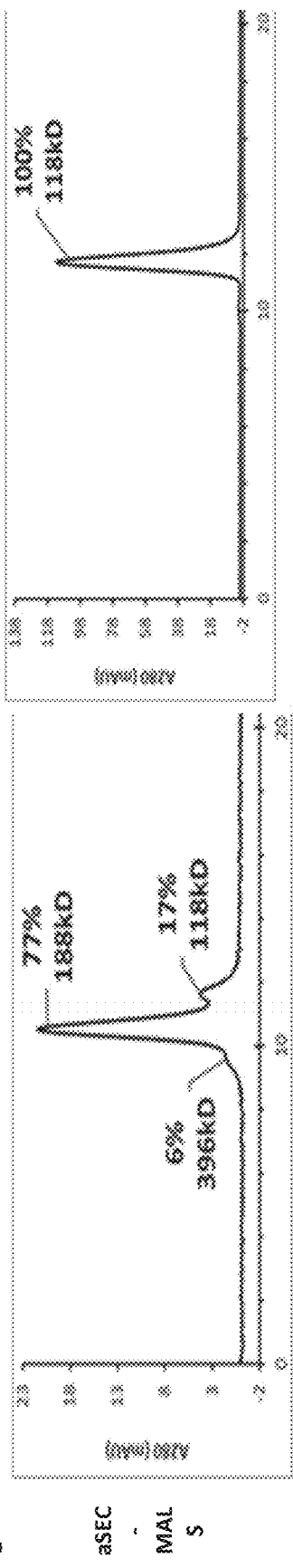
Figure 14C:
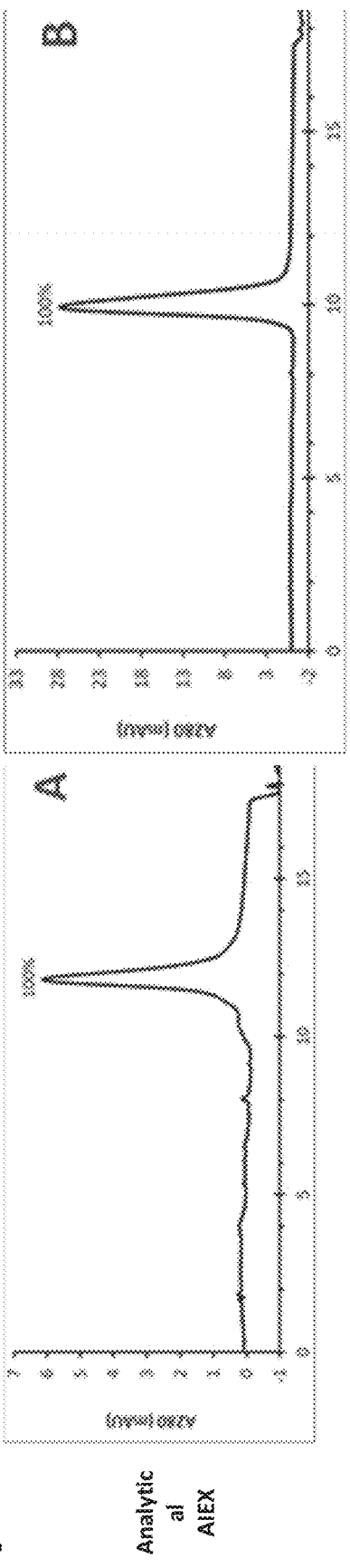

FIG. 14A-FIG. 14C depicts A) chromatogram illustrating purification part 2 of XENP27203 (anion exchange chromatography following protein A chromatography), and the purity and homogeneity of peak B isolated from anion exchange separation as depicted in FIG. 14A in comparison to peak A as determined by B) analytical size-exclusion chromatography with multi-angle light scattering (SEC-MALS) and C) analytical anion exchange chromatography. FIG. 14B also depicts the molecular weight of protein species in peaks as determined by multi-angle light scattering.

Figure 15A:
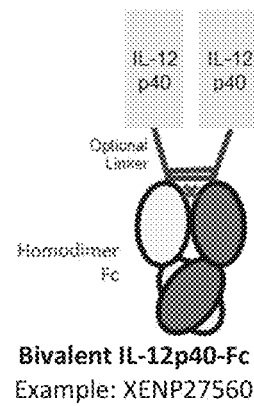
Figure 15B:
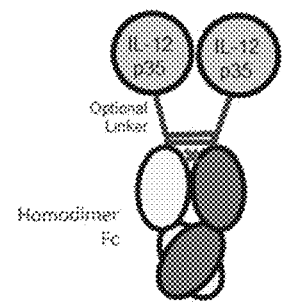
Figure 17A:
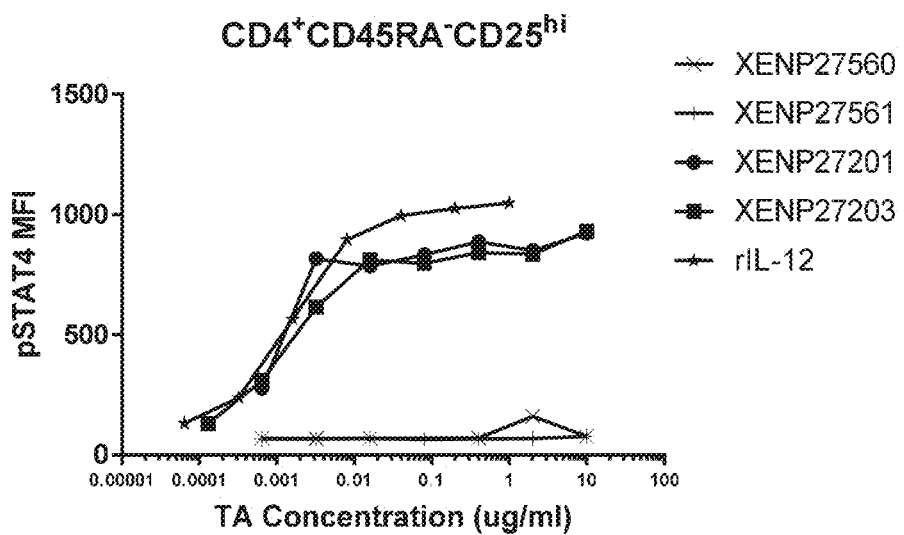
Figure 17B:
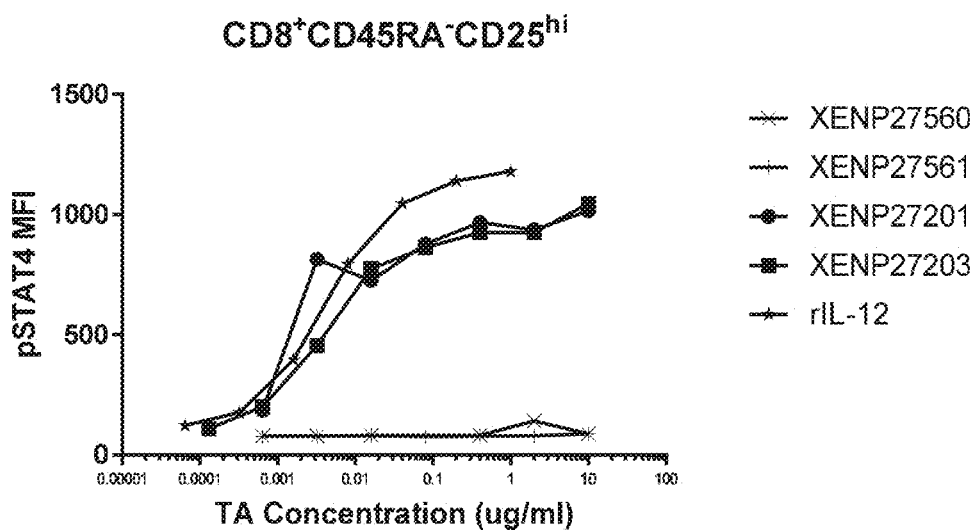
Figure 17C:
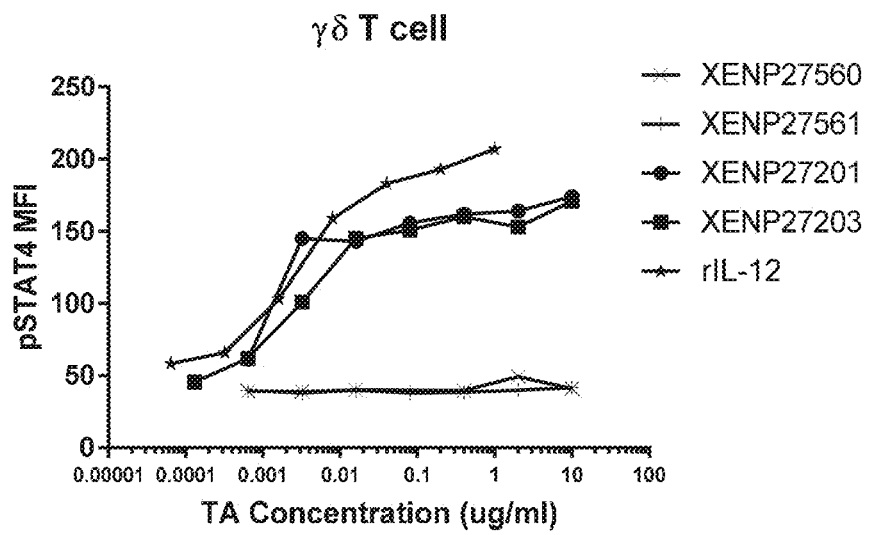
Figure 17D:
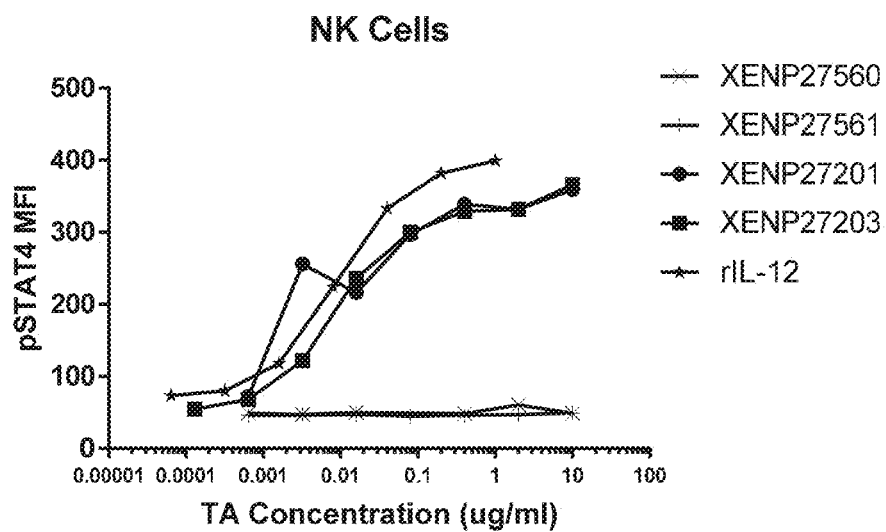

FIG. 15A and FIG. 15B depicts cartoon schematics for A) bivalent IL-12p40-Fc fusion and B) bivalent IL-12p35-Fc fusion. Each fusion comprises either IL-12p40 or IL-12p35 subunits recombinant fused to the N-terminus of a homodimeric Fc. The subunits may have a domain linker between their respective C-terminus and the N-terminus of the Fc region.

FIG. 16 depicts the sequences of XENP27560, a bivalent IL-12p40-Fc fusion, and XENP27561, a bivalent IL-12p35-Fc fusion (cartoon schematics depicted in FIGS. 15A and 15B), that contains the wildtype IL-12p40 and wildtype IL-12p35 sequences. Linkers are double underlined (although as will be appreciated by those in the art, the linkers can be replaced by other linkers, some of which are depicted in FIG. 6), and slashes (/) indicate the border(s) between IL-12p35, IL-12p40, linkers, and Fc regions.

FIG. 17A-FIG. 17D depicts STAT4 phosphorylation on A) CD4$^+$CD45RA$^-$CD25$^{hi}$ T cells, B) CD8$^+$CD45RA$^-$CD25$^{hi}$ T cells, C) γδ T cells, and D) NK cells following incubation of activated PBMCs with the indicated test articles.

FIG. 18 depicts residues on IL-12p40 (based on IL-12p40 mature form sequence) predicted to contribute to the binding of IL-12p40 with IL-12 receptors.

FIG. 19 depicts aspartic acid, glutamic acid, asparagine, and glutamine residues on IL-12p40 (based on IL-12p40 mature form sequence) identified using the QuaSAR package in MOE to have an ASA score (water accessible surface area calculated using a radius of 1.4 Å for the water molecule and a polyhedral representation for each atom) of at least 19.

FIG. 20 depicts residues on IL-12p40 (based on IL-12p40 mature form sequence) predicted to be in contact with IL-23 receptors (based on crystal structure deposited in the PDB with accession number 5MZV) as well as the predicted contact type(s). "D" indicates contact predicted based on proximity. "H" indicates contact predicted based on potential hydrogen bond. "I" indicates contact predicted based on potential salt bridge. "A" indicates contact predicted based potential arene binding.

FIG. 21A-FIG. 21G depict sequences for illustrative IL-12p40 variants designed with the view to reduce the affinity of the IL-12 heterodimeric complex for the IL-12 receptors and/or remove putative glycosylation sites. Modified amino acids are underlined and in bold.

FIG. 22A-FIG. 22G depict the amino acid sequences for illustrative IL-12p40 variants with Fc fusion partners. Domain linkers are double-underlined, and IL-12p40 variants are italicized.

FIG. 23 depicts aspartic acid, glutamic acid, asparagine, and glutamine residues on IL-12p35 (based on IL-12p35 mature form sequence) identified using the QuaSAR package in MOE to have an ASA score (water accessible surface area calculated using a radius of 1.4 Å for the water molecule and a polyhedral representation for each atom) of at least 103.

FIG. 24A-FIG. 24C depict sequences for illustrative IL-12p35 variants designed with the view to reduce the affinity of the IL-12 heterodimeric complex for the IL-12 receptors and/or remove putative glycosylation sites. Modified amino acids are underlined and in bold.

FIG. 25A-FIG. 25C depicts the amino acid sequences for illustrative IL-12p35 variants with Fc fusion partners. Domain linkers are double-underlined, and IL-12p35 variants are italicized.

FIG. 26A-FIG. 26Q depicts sequences for illustrative variant IL-12-Fc fusions designed with the view to reduce the affinity of the IL-12-Fc fusions for IL-12 receptors or to remove putative glycosylation sites. Linkers are double underlined (although as will be appreciated by those in the art, the linkers can be replaced by other linkers, and slashes (/) indicate the border(s) between IL-12p35, IL-12p40, linkers, and Fc regions.

Figure 27A:
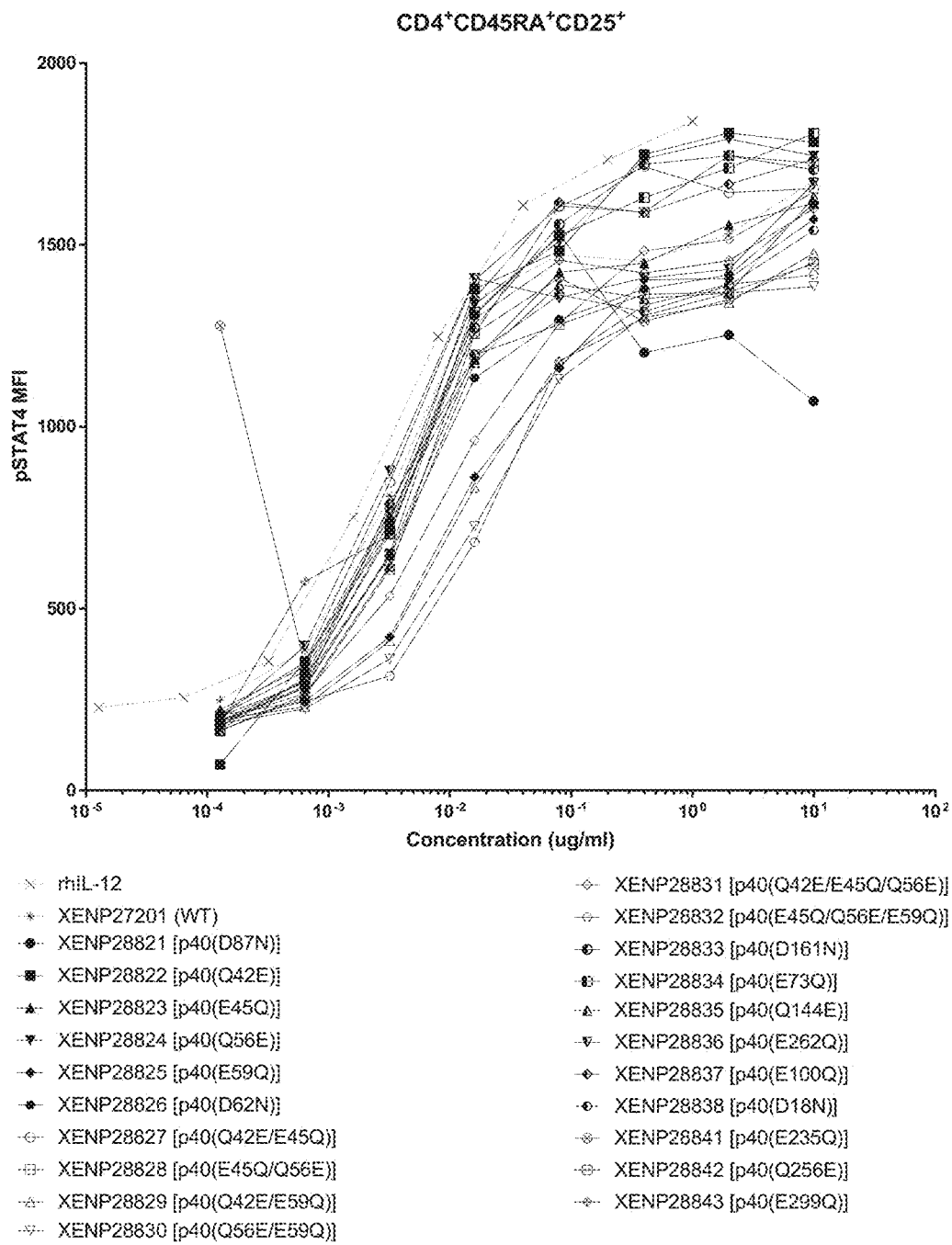
Figure 27B:
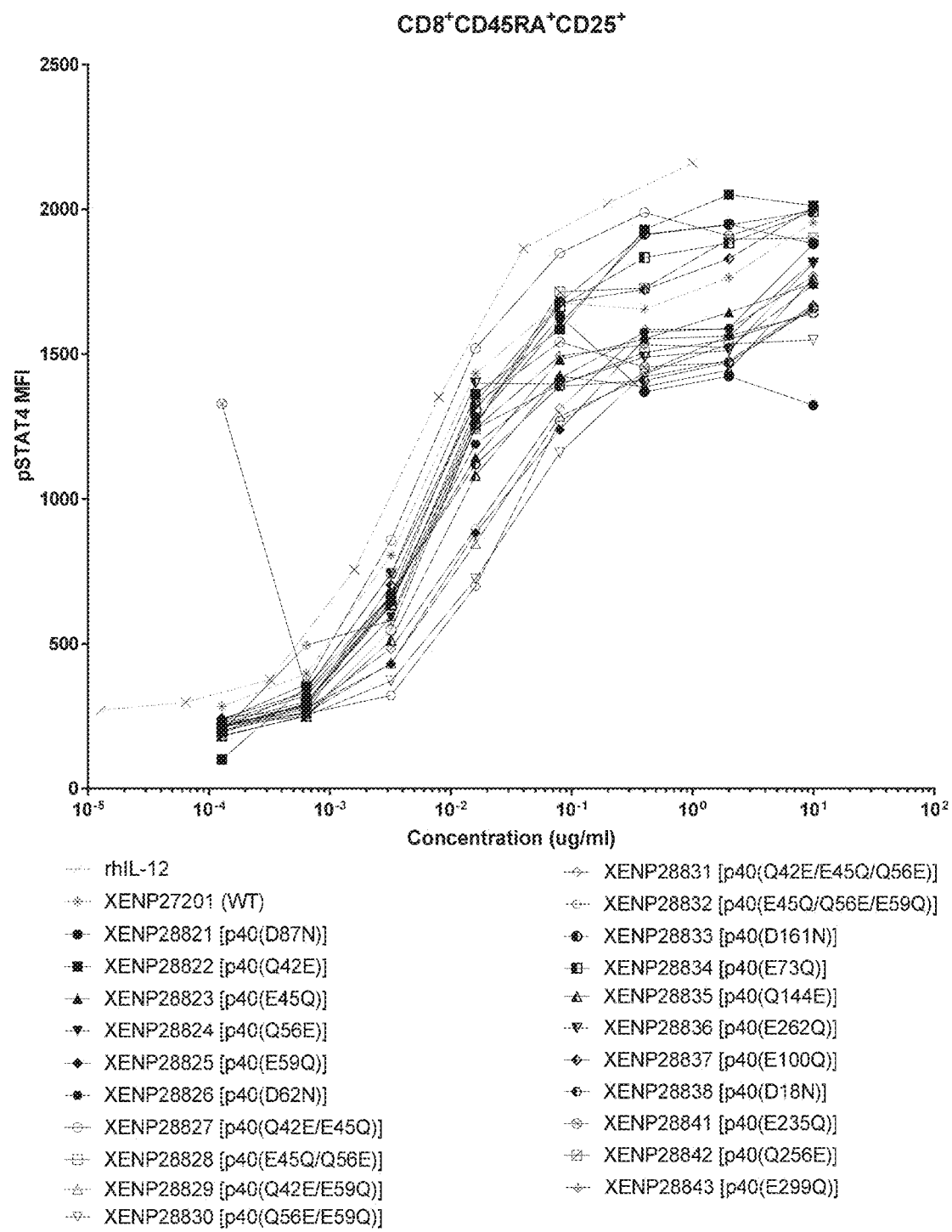
Figure 28A:
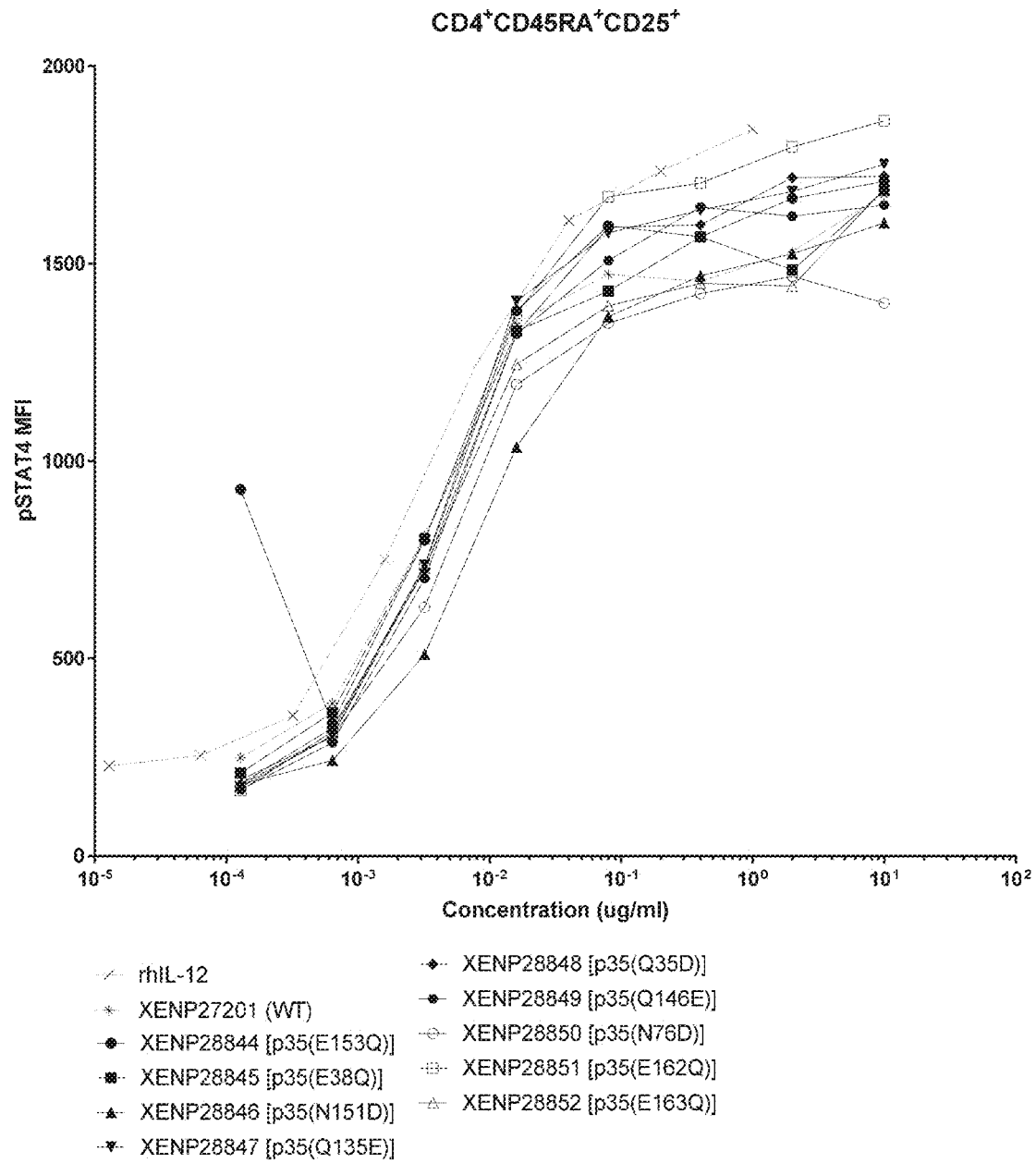
Figure 28B:
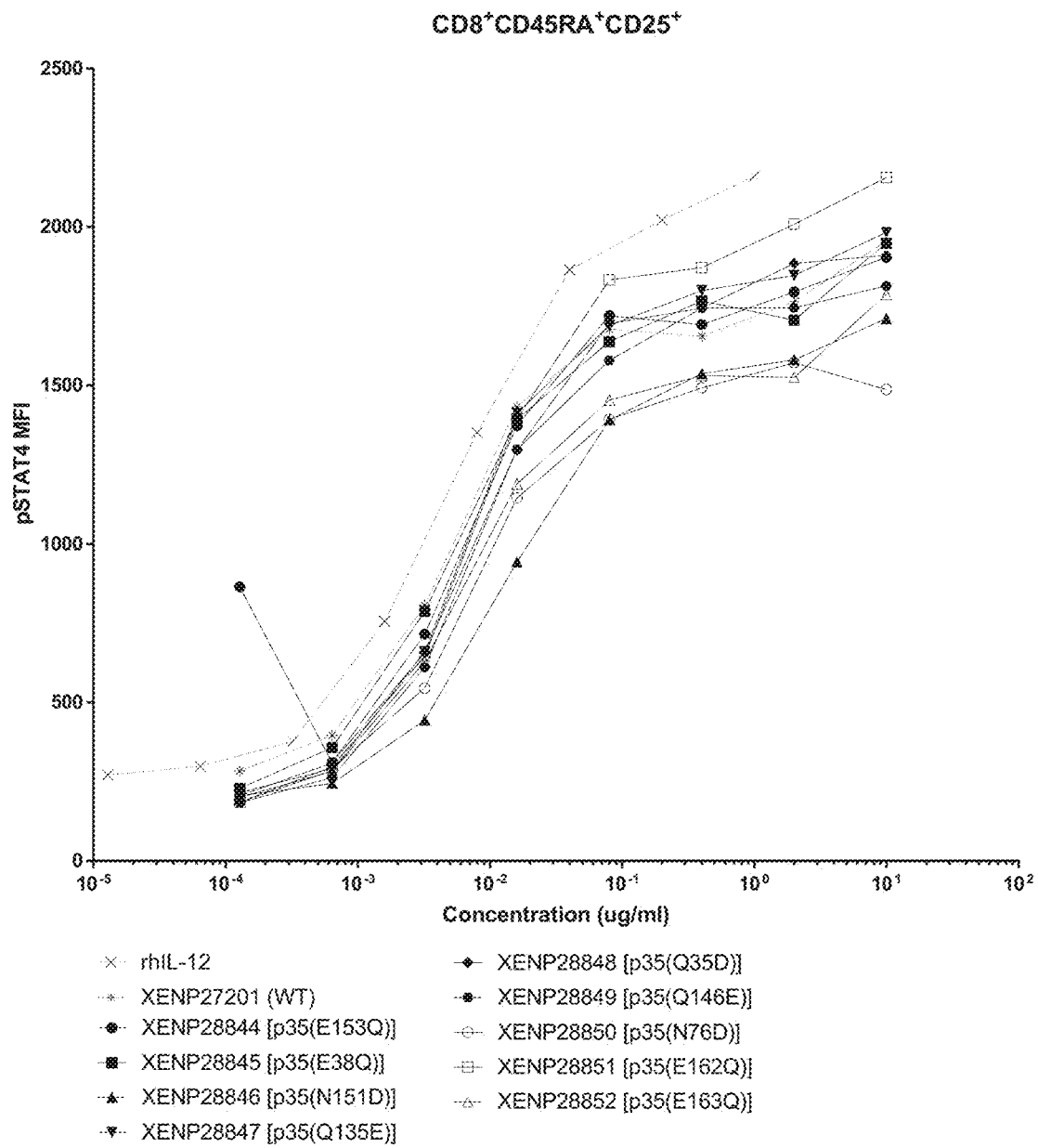

FIG. 27A-FIG. 27B depict STAT4 phosphorylation on A) CD4$^+$CD45RA$^+$CD25$^+$ T cells and B) CD8$^+$CD45RA$^+$CD25$^+$ T cells following incubation of activated PBMCs with IL-12-Fc fusions comprising IL-12p40 variants engineered with an aim to reduce affinity and potency FIG. 28A-FIG. 28B depict STAT4 phosphorylation on A) CD4$^+$CD45RA$^+$CD25$^+$ T cells and B) CD8$^+$CD45RA$^+$CD25$^+$ T cells following incubation of activated PBMCs with IL-12-Fc fusions comprising IL-12p35 variants engineered with an aim to reduce affinity and potency.

FIG. 29 depicts the EC50 (for STAT4 phosphorylation) as IL-12-Fc fusions comprising IL-12p40 or IL-12p35 variants and the fold decrease in EC50 relative to WT IL-12-Fc XENP27201. 27201-1 and 27201-2 represent two separately produced batches of XENP27201.

FIG. 30A-FIG. 30B depict sequences for illustrative IL-12p40 variants designed with the view to reduce the affinity of the IL-12 heterodimeric complex for the IL-12 receptors. Modified amino acids are underlined and in bold.

FIG. 31A-FIG. 31C depict the amino acid sequences for illustrative IL-12p40 variants with Fc fusion partner. Domain linkers are double-underlined, and IL-12p40 variants are italicized.

FIG. 32 depicts sequences for illustrative IL-12p35 variants designed with the view to reduce the affinity of the IL-12 heterodimeric complex for the IL-12 receptors. Modified amino acids are underlined and in bold.

FIG. 33A-FIG. 33B depict the amino acid sequences for illustrative IL-12p35 variants with Fc fusion partners. Domain linkers are double-underlined, and IL-12p35 variants are italicized.

FIG. 34A-FIG. 34L depict sequences for illustrative variant IL-12-Fc fusions designed with the view to reduce the affinity of the IL-12-Fc fusions for IL-12 receptors. Linkers are double underlined (although as will be appreciated by those in the art, the linkers can be replaced by other linkers, some of which are depicted in FIG. 6), and slashes (/) indicate the border(s) between IL-12p35, IL-12p40, linkers, and Fc regions.

Figure 35A:
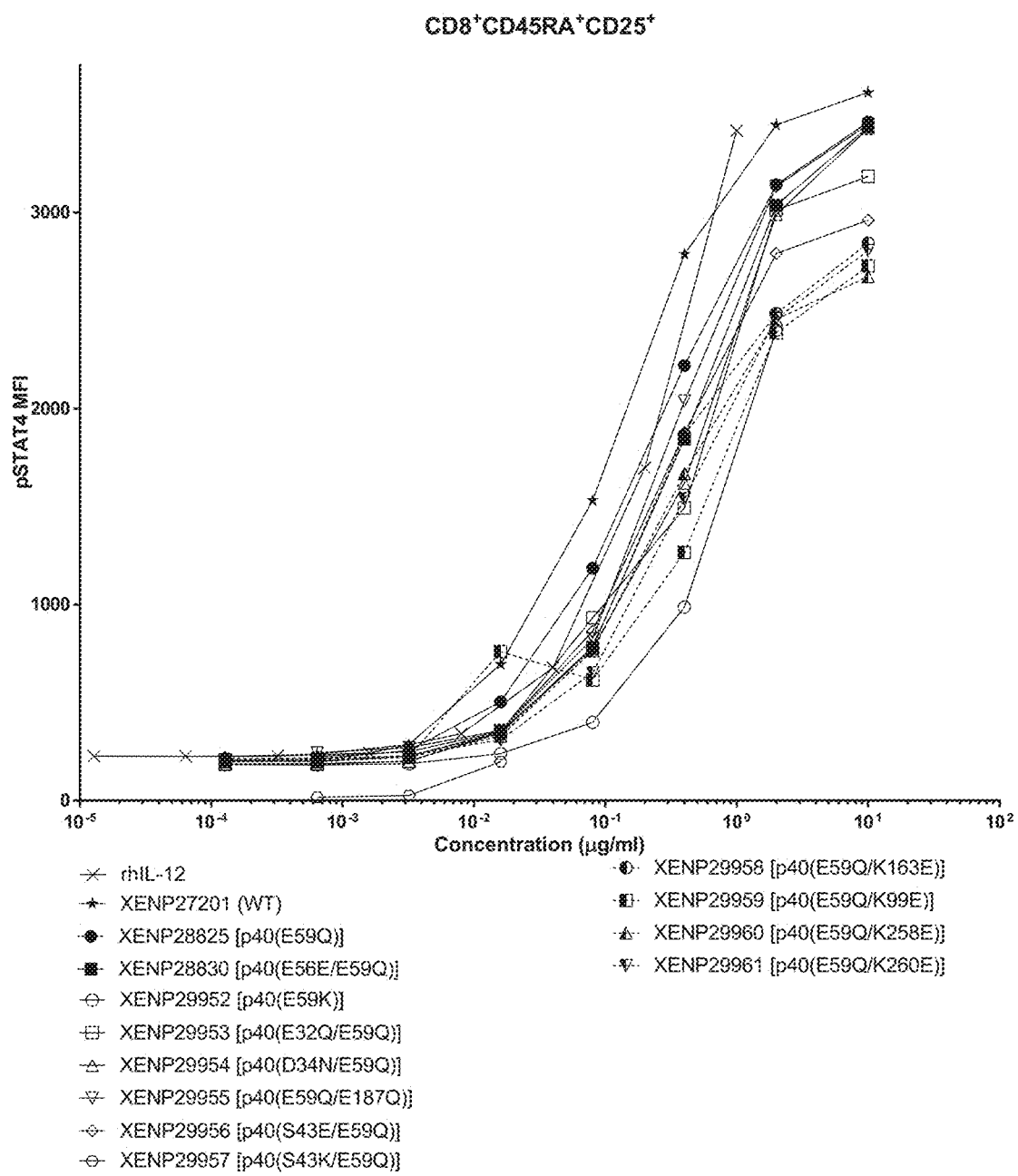
Figure 35B:
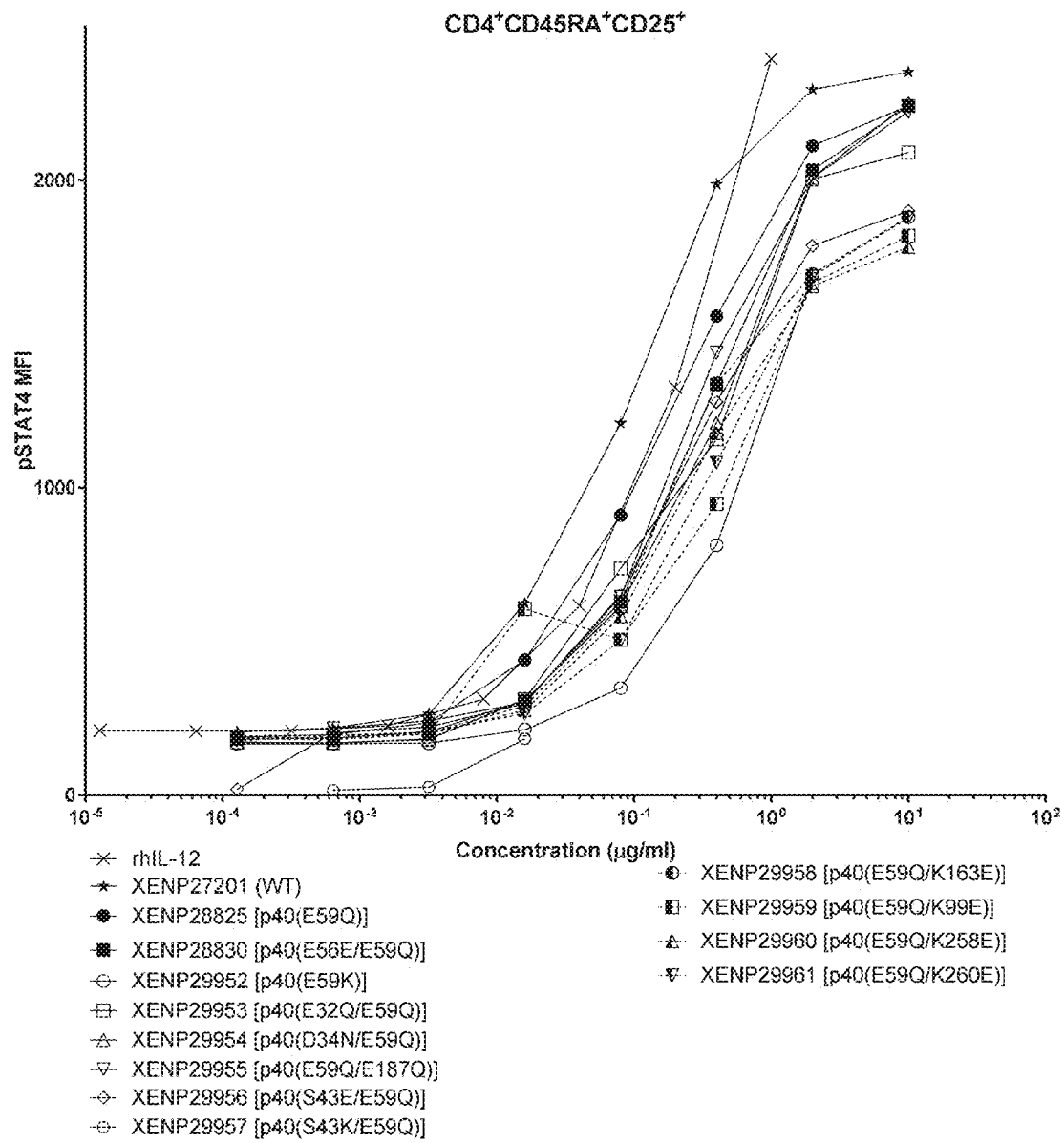

FIG. 35A and FIG. 35B depict STAT4 phosphorylation on A) CD4$^+$CD45RA$^+$CD25$^+$ T cells and B) CD8$^+$CD45RA$^+$CD25$^+$ T cells following incubation of activated PBMCs with IL-12-Fc fusions comprising IL-12p40 variants engineered with an aim to reduce affinity and potency.

Figure 36A:
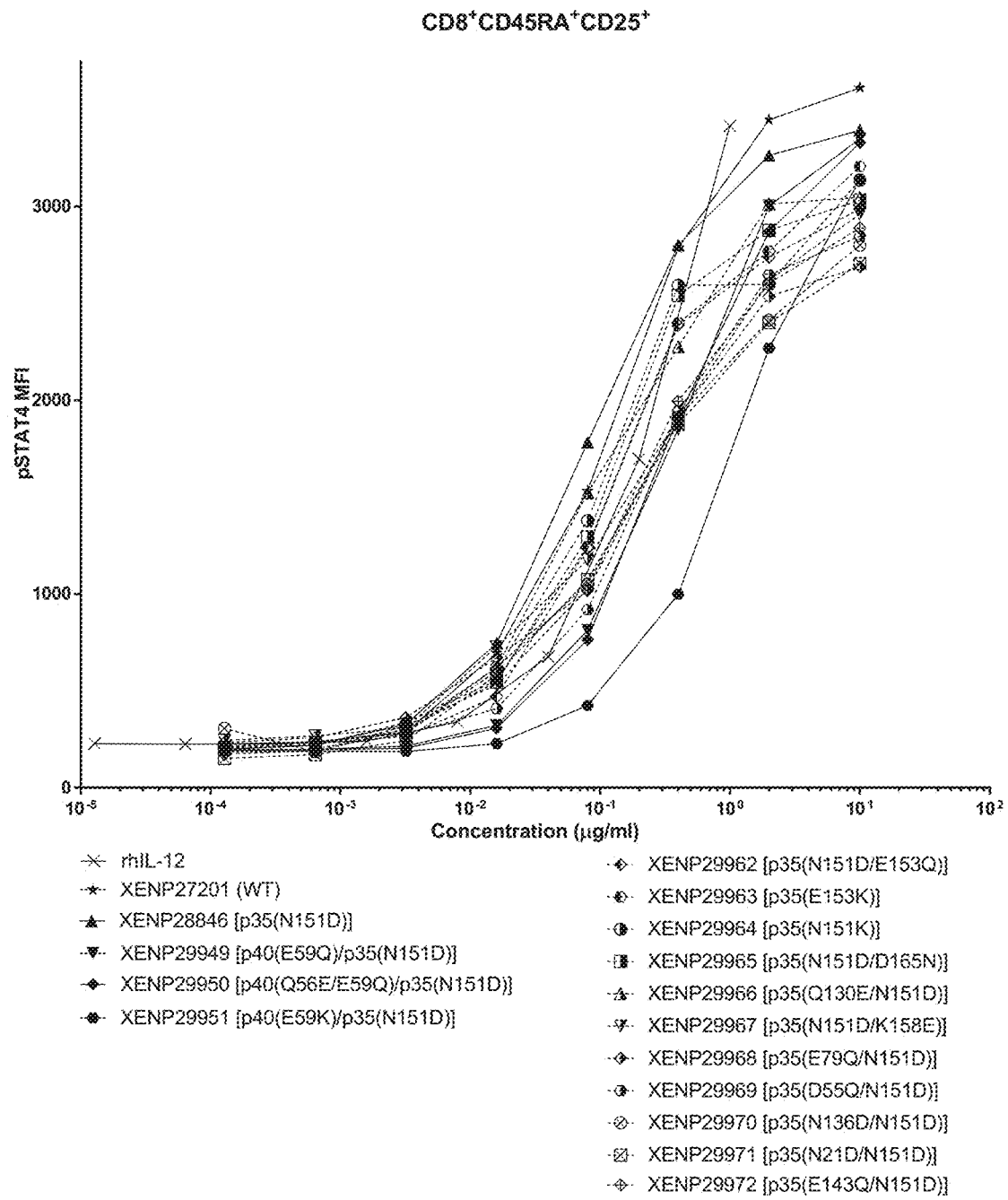
Figure 36B:
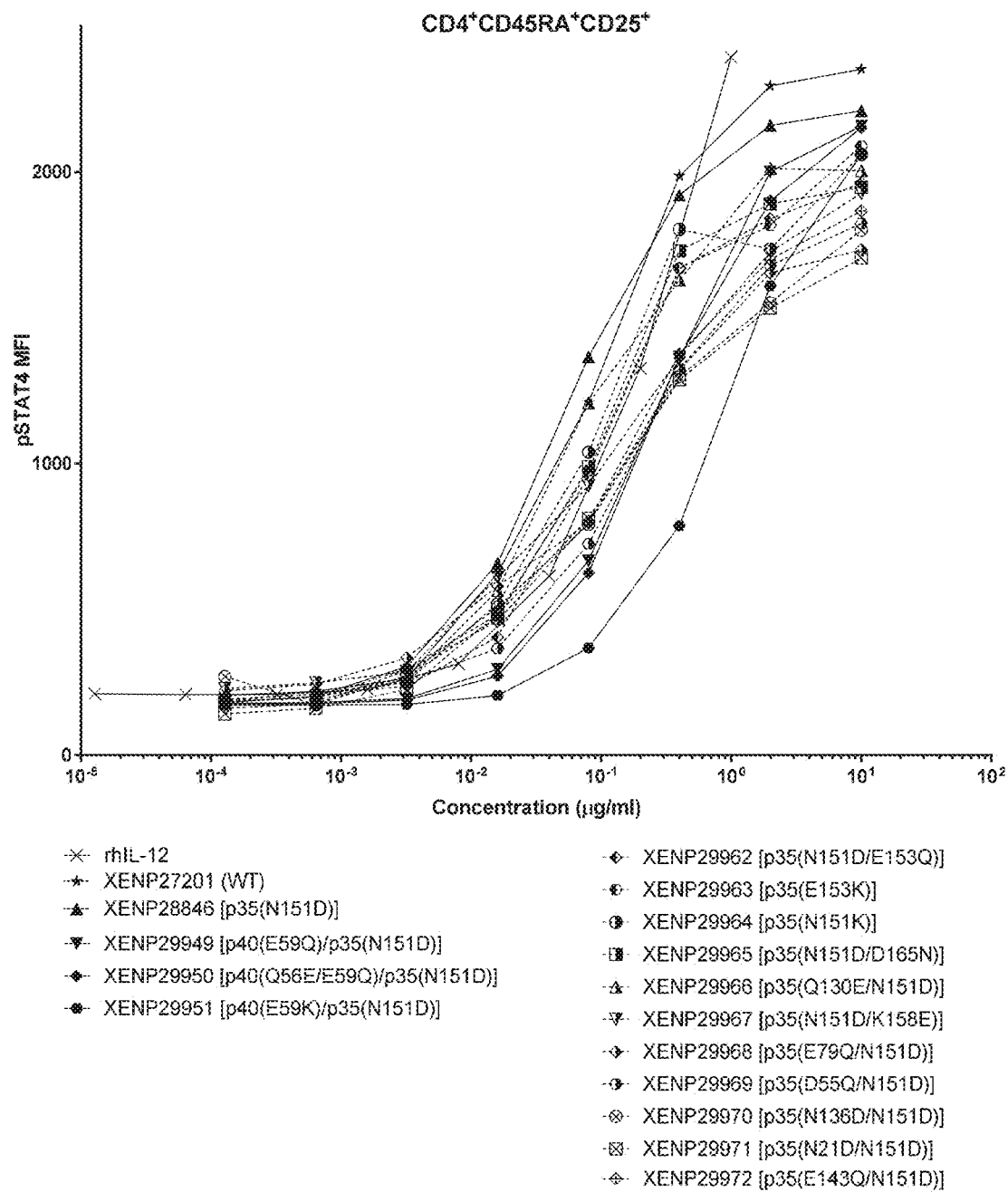

FIG. 36A and FIG. 36B depict STAT4 phosphorylation on A) CD4$^+$CD45RA$^+$CD25$^+$ T cells and B) CD8$^+$CD45RA$^+$CD25$^+$ T cells following incubation of activated PBMCs with IL-12-Fc fusions comprising IL-12p40 and/or IL-12p35 variants engineered with an aim to reduce affinity and potency.

FIG. 37 depicts the EC50 (for STAT4 phosphorylation) of IL-12-Fc fusions comprising IL-12p40 and/or IL-12p35 variants and the fold decrease in EC50 relative to WT IL-12-Fc XENP27201. The data show that potency was reduced by up to 12-fold by an IL-12-Fc fusion comprising only a E59K substitution in the IL-12p40 subunit.

FIG. 38 depicts sequences for illustrative IL-12p40 variants designed with the view to reduce the affinity of the IL-12 heterodimeric complex for the IL-12 receptors. Modified amino acids are underlined and in bold.

FIG. 39 depicts sequences for illustrative IL-12p35 variants designed with the view to reduce the affinity of the IL-12 heterodimeric complex for the IL-12 receptors. Modified amino acids are underlined and in bold.

FIG. 40A-FIG. 40G depict sequences for illustrative variant IL-12-Fc fusions designed with the view to reduce the affinity of the IL-12-Fc fusions for IL-12 receptors. Linkers are double underlined (although as will be appreciated by those in the art, the linkers can be replaced by other linkers, some of which are depicted in FIG. 6), and slashes (/) indicate the border(s) between IL-12p35, IL-12p40, linkers, and Fc regions.

Figure 41A:
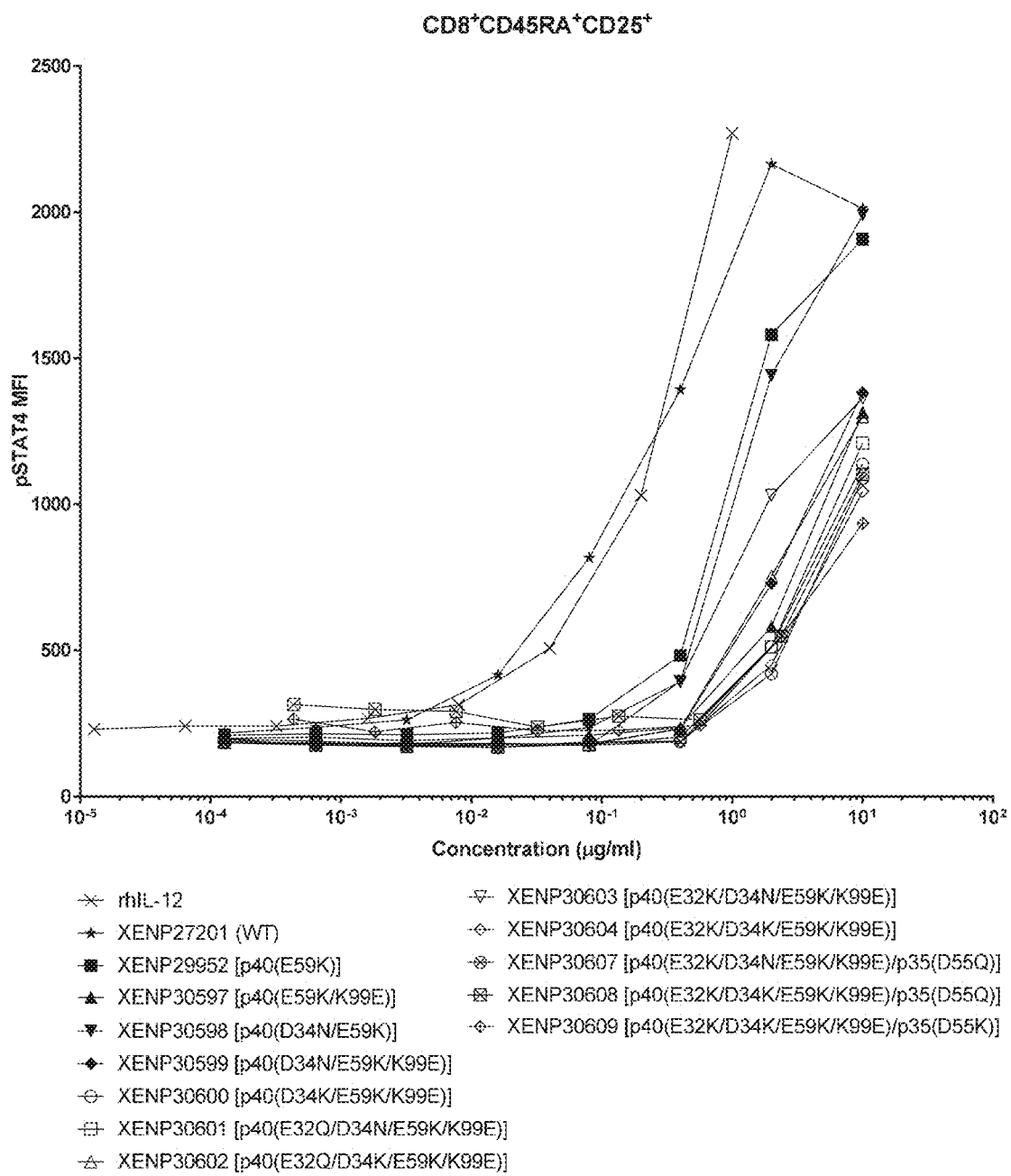
Figure 41B:
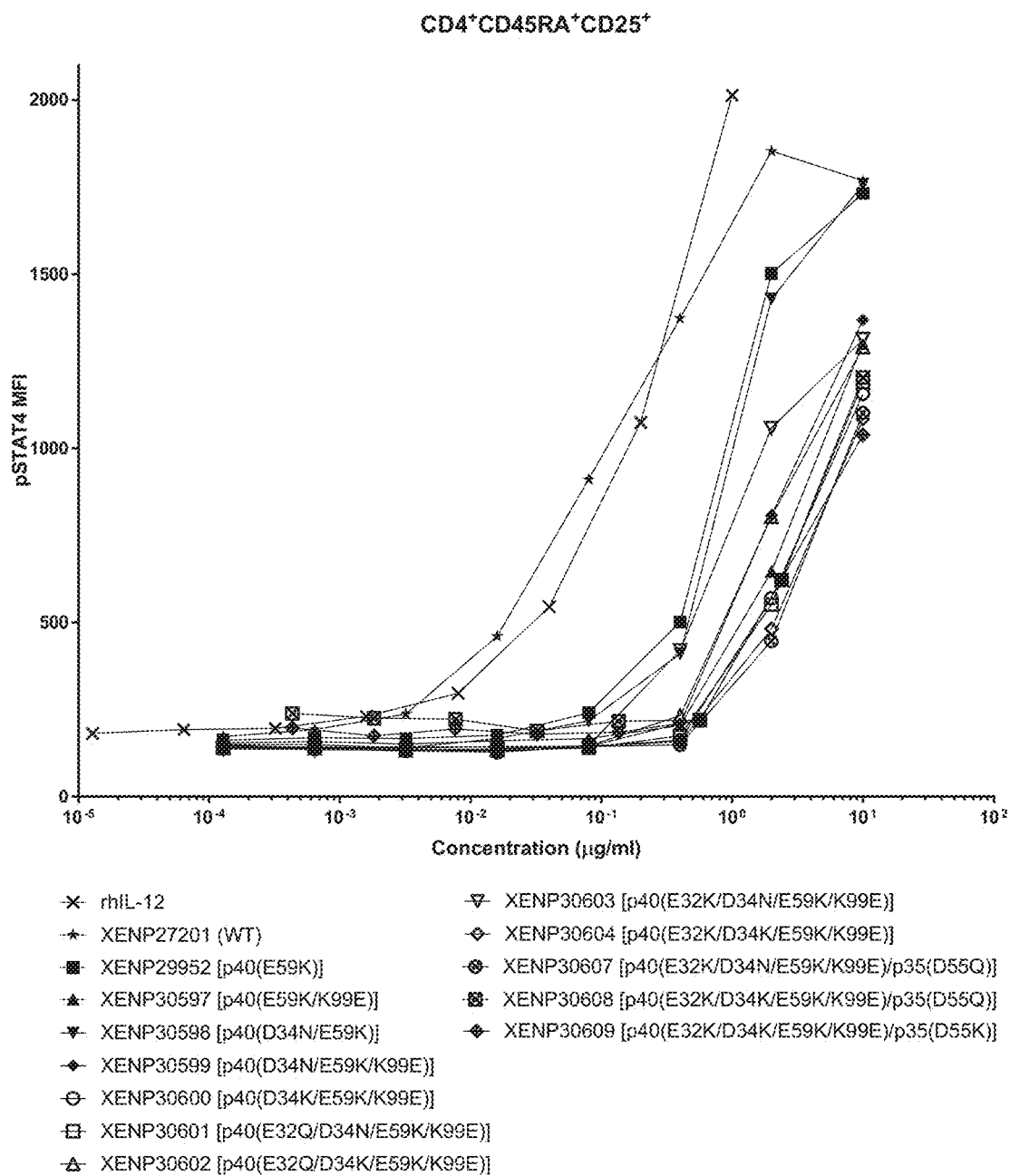
Figure 47A:
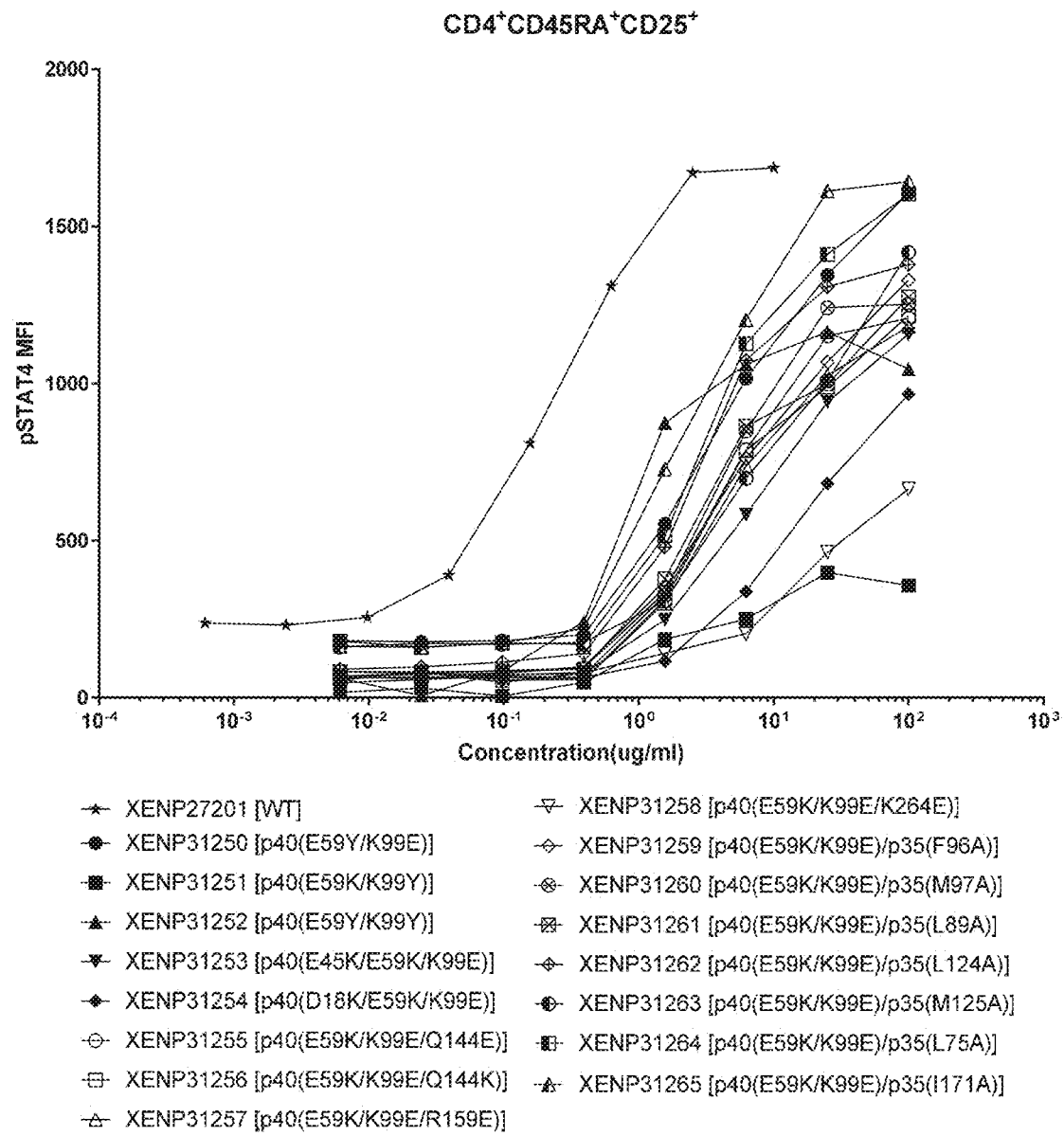
Figure 47B:
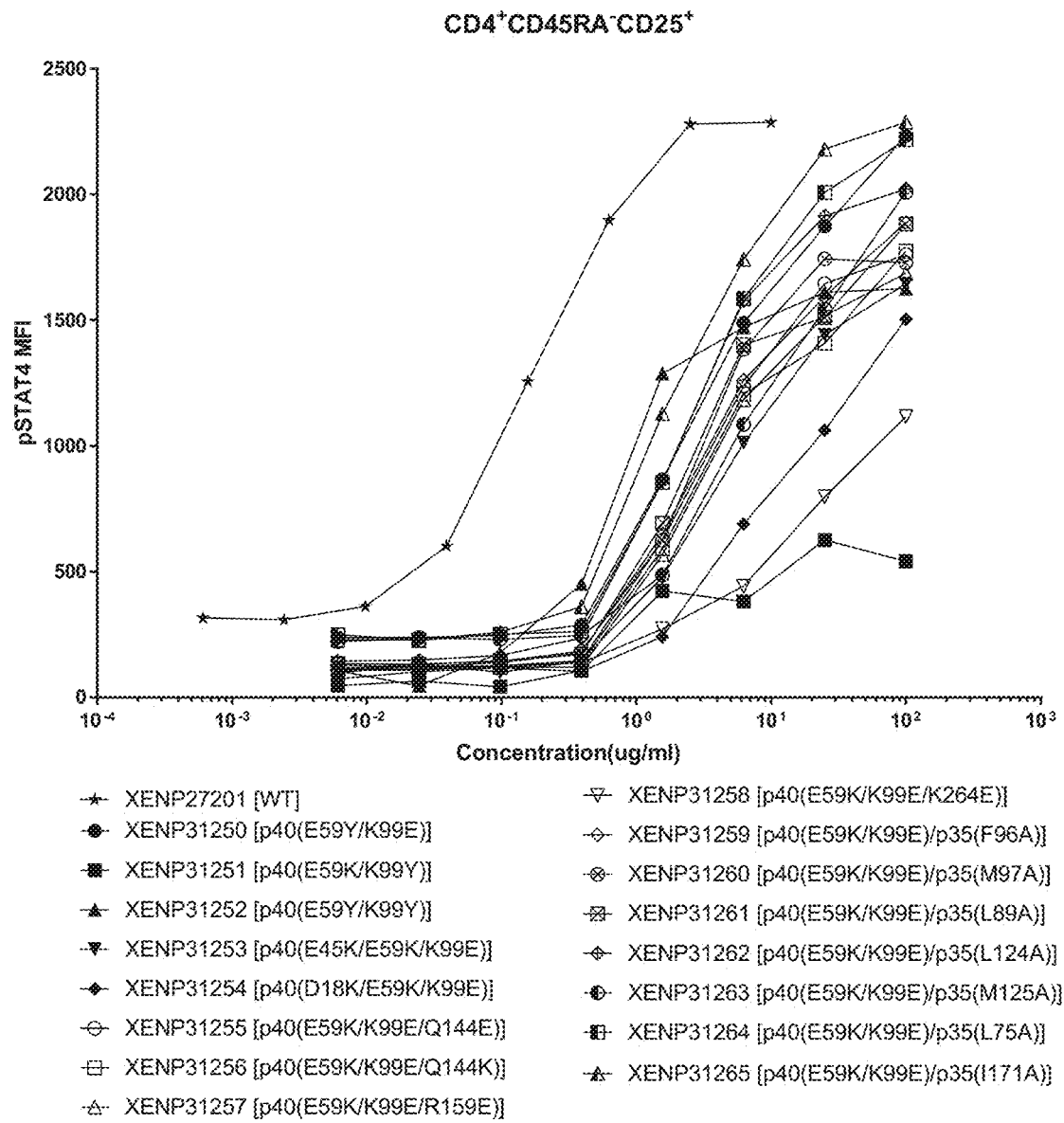
Figure 47C:
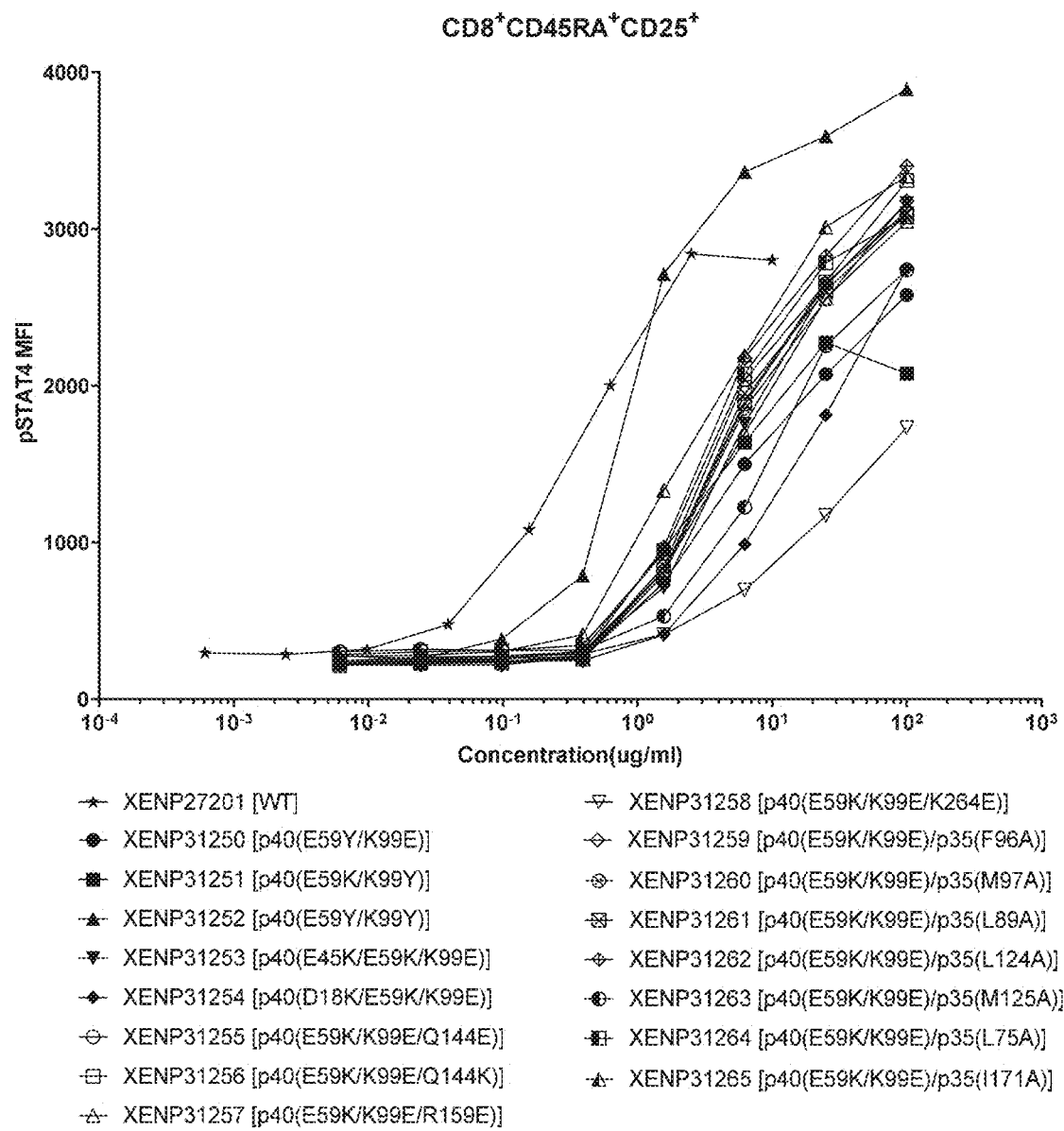
Figure 47D:
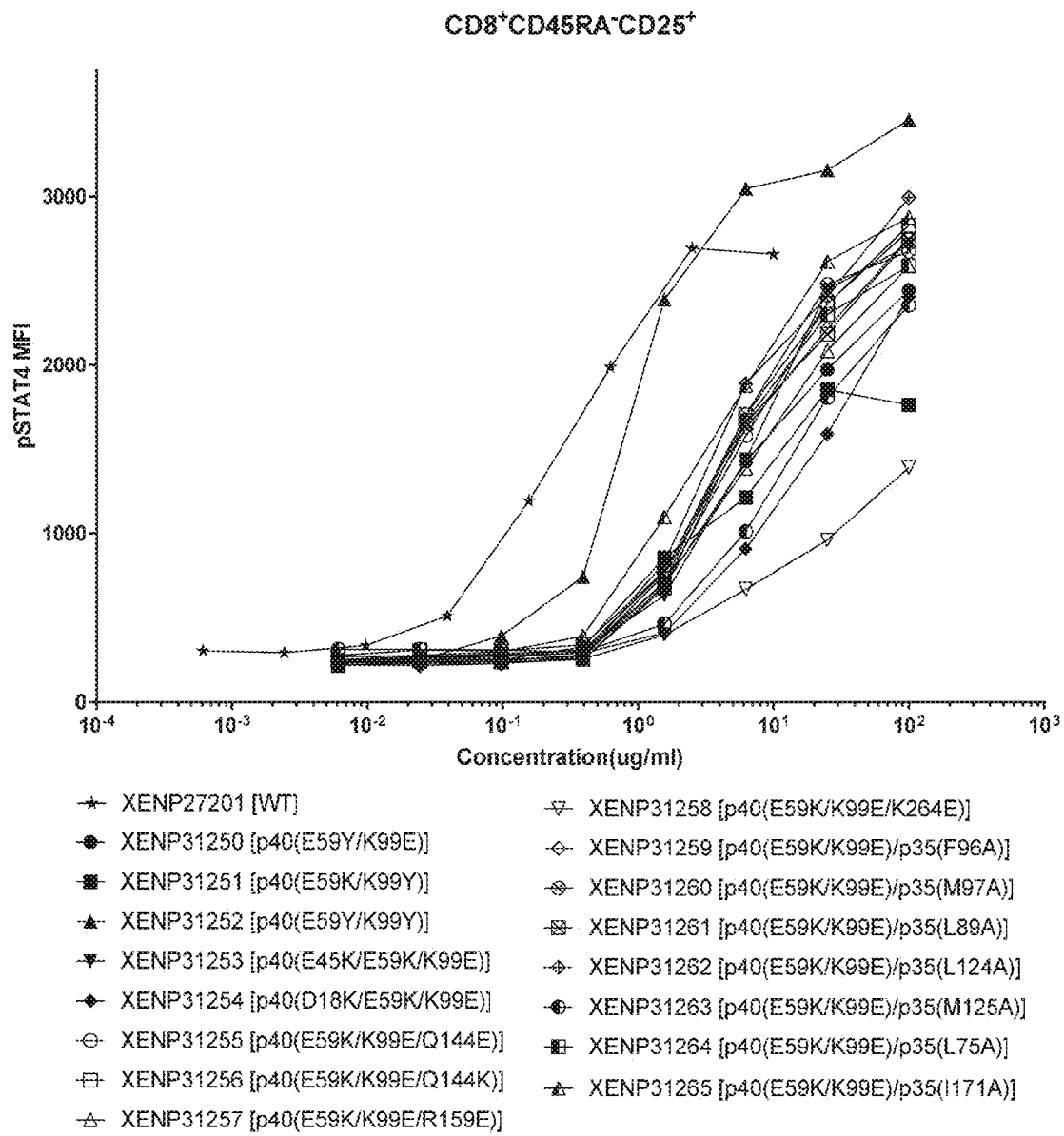
Figure 49A:
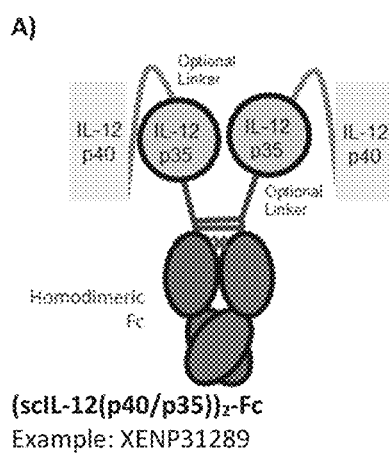
Figure 49B:
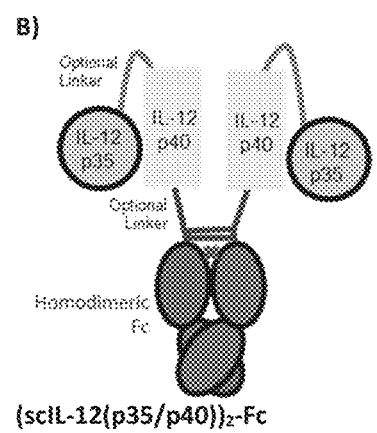
Figure 49C:
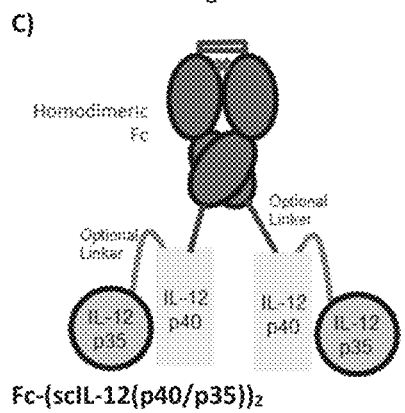
Figure 49D:
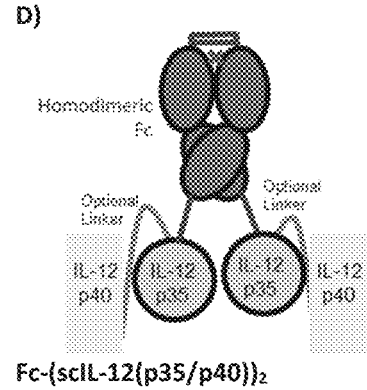
Figure 52A:
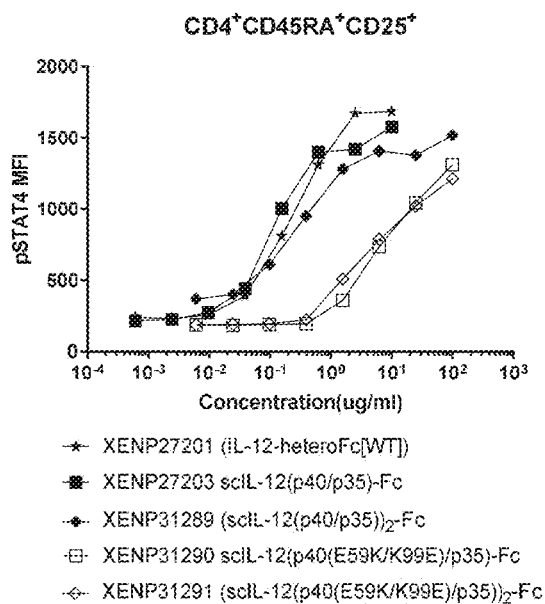
Figure 52B:
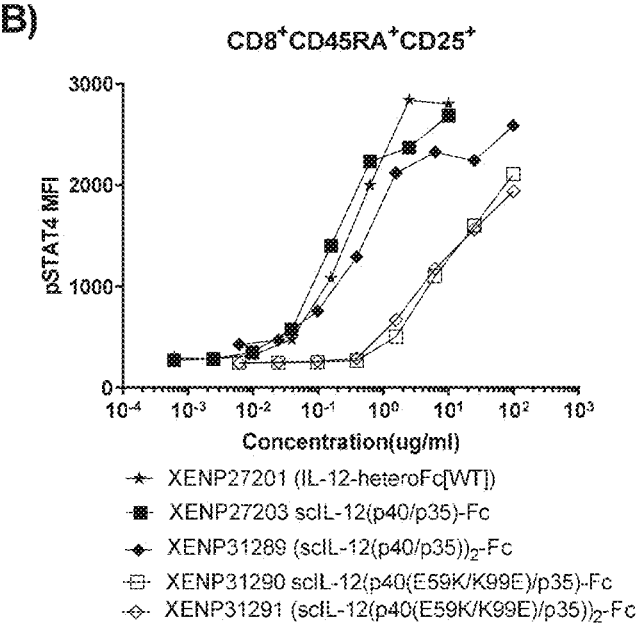
Figure 52C:
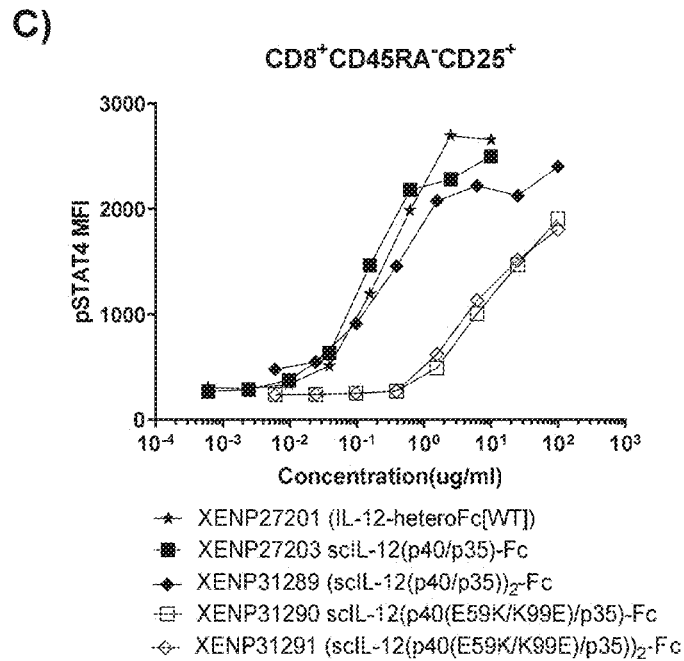
Figure 52D:
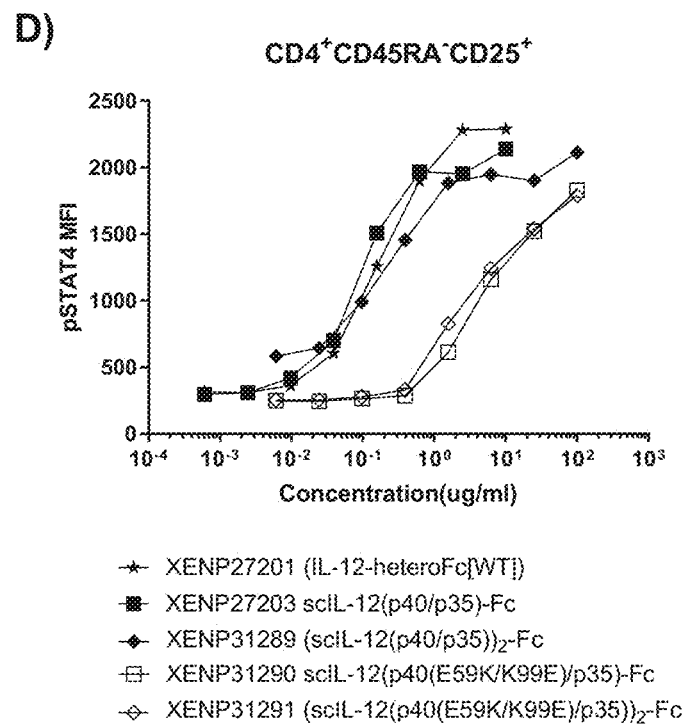
Figure 55A:
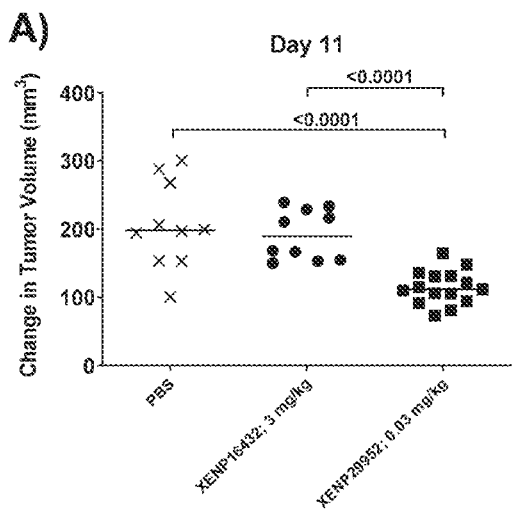
Figure 55B:
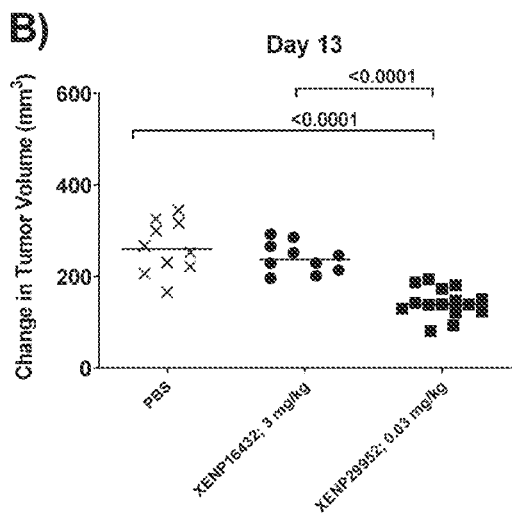
Figure 55C:
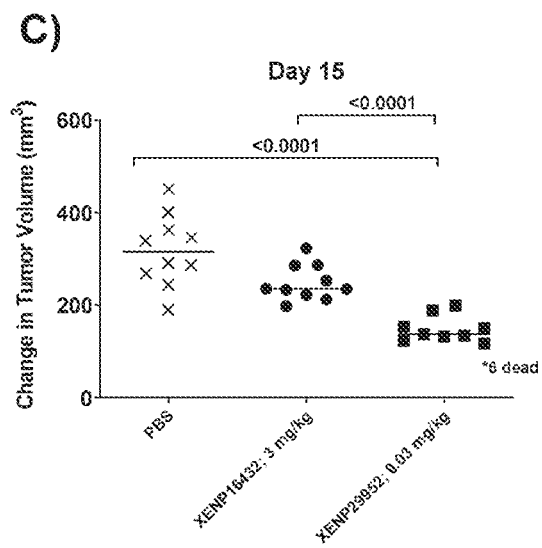
Figure 55D:
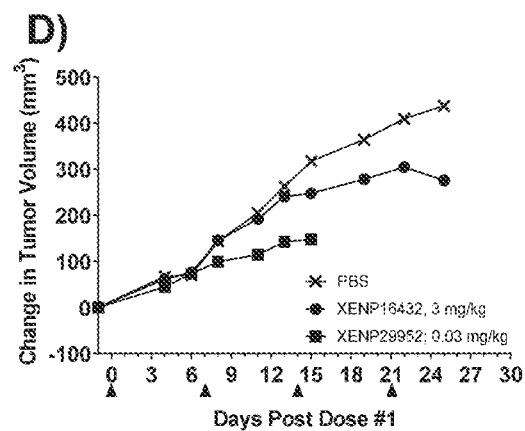
Figure 56A:
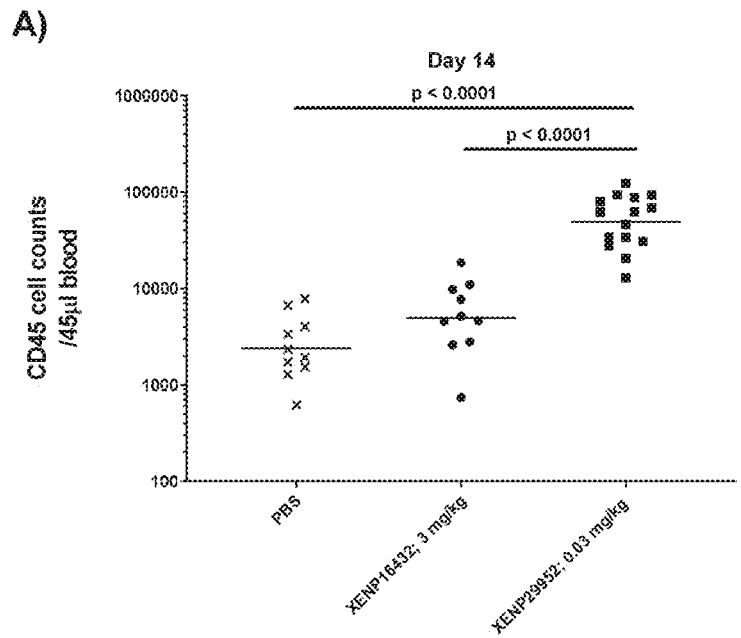
Figure 56B:
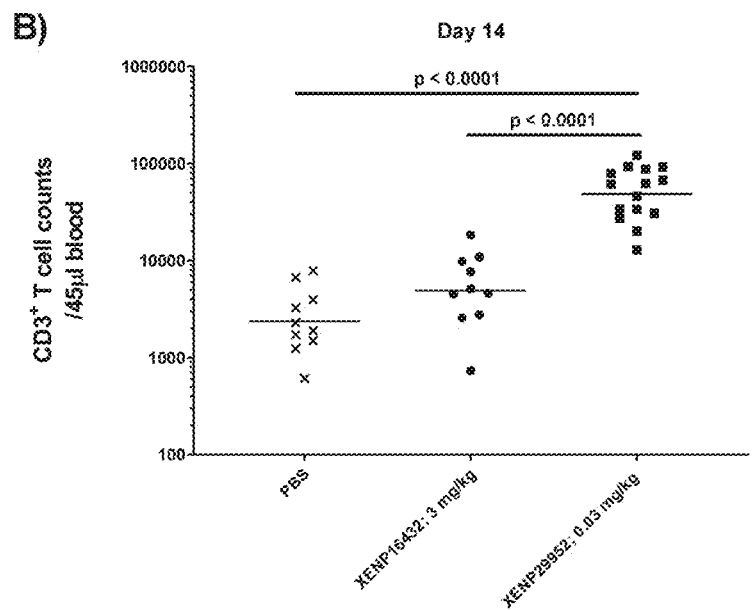
Figure 56C:
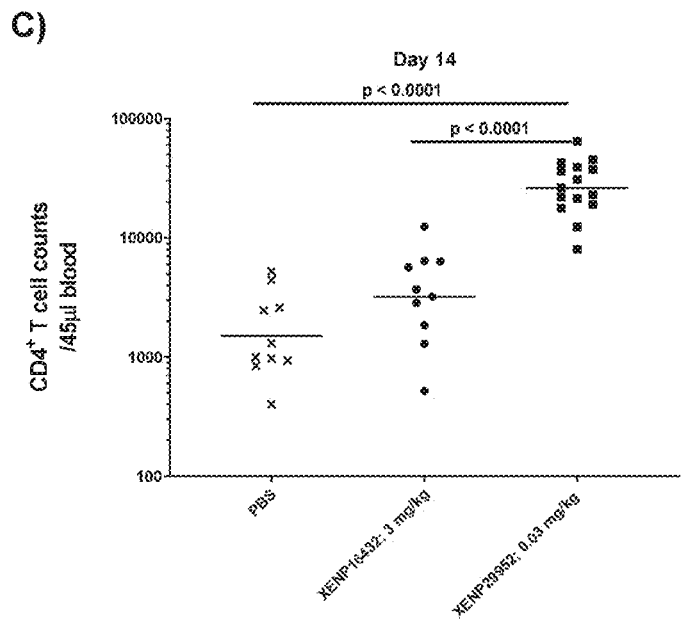
Figure 56D:
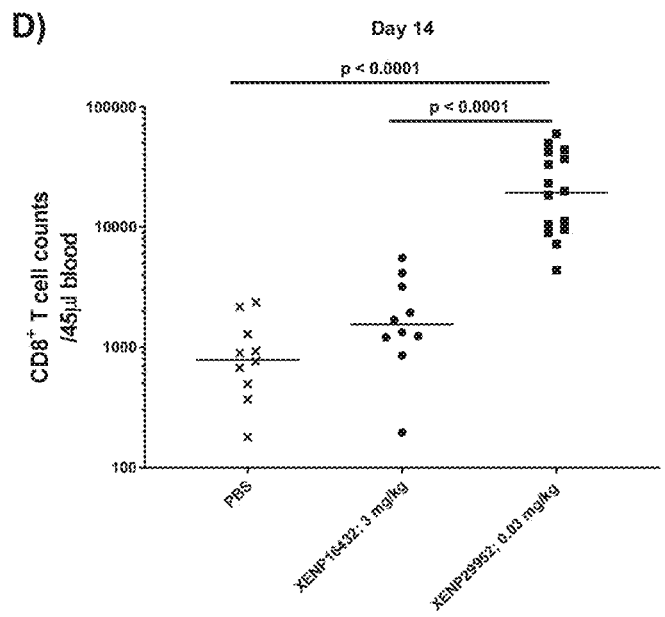
Figure 56E:
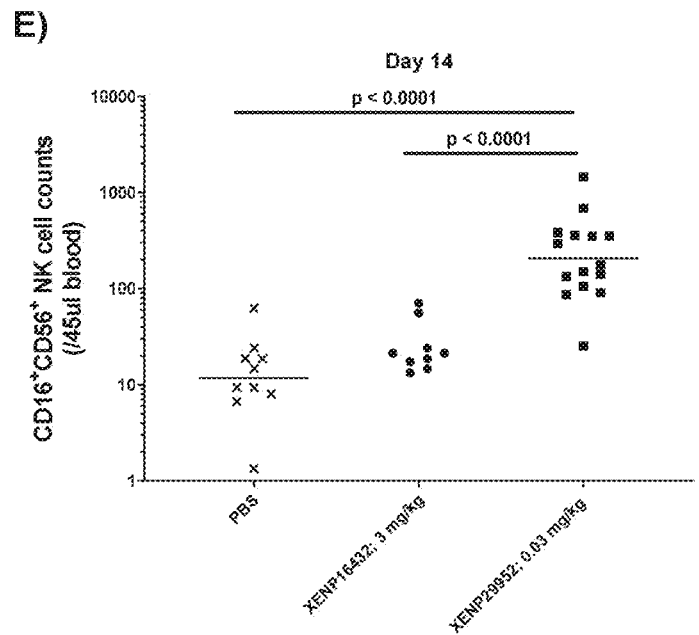
Figure 56F:
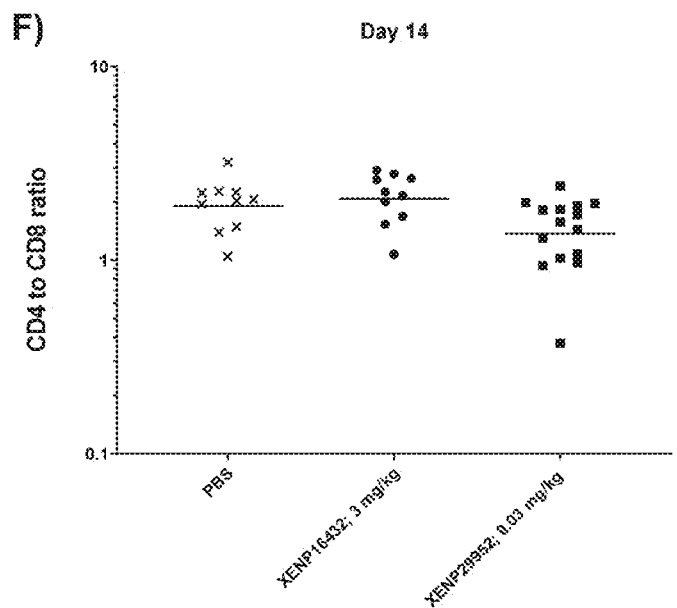
Figure 57A:
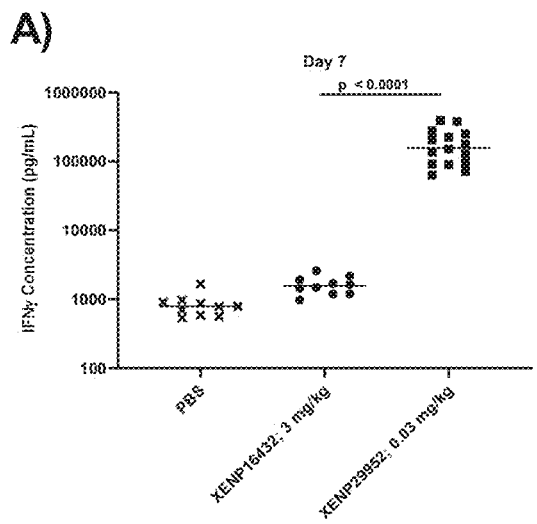
Figure 57B:
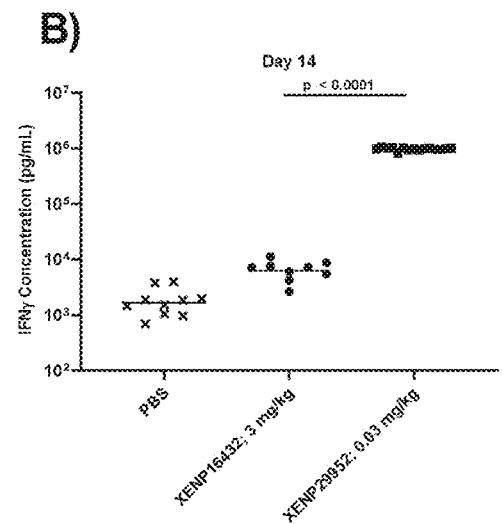
Figure 57C:
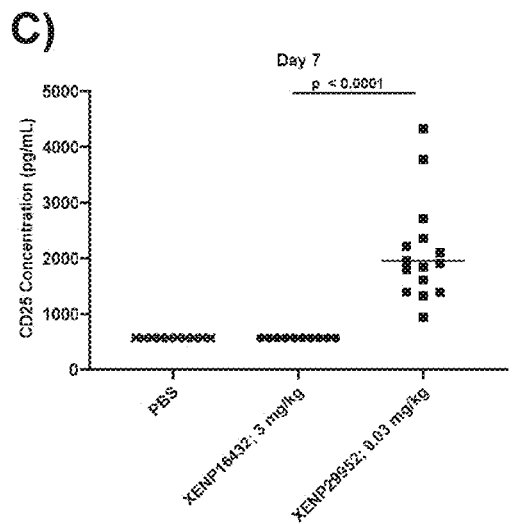
Figure 57D:
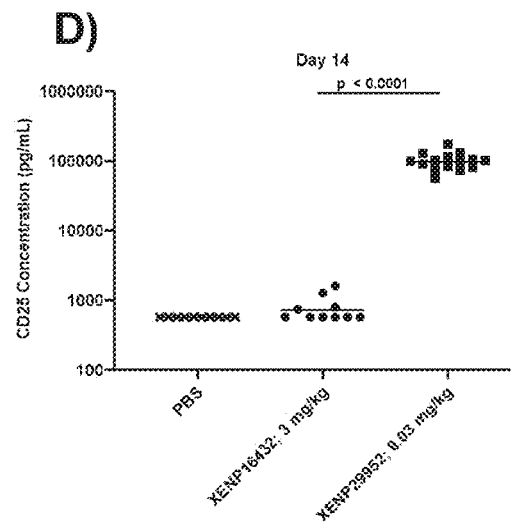
Figure 58A:
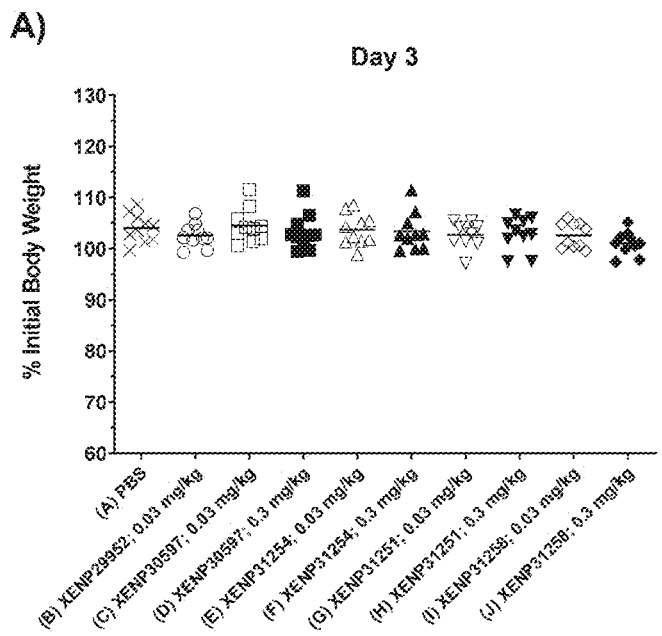
Figure 58B:
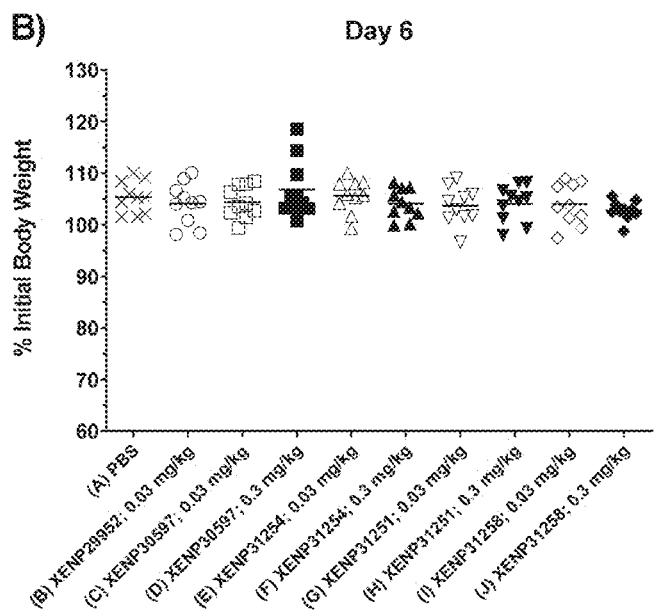
Figure 58C:
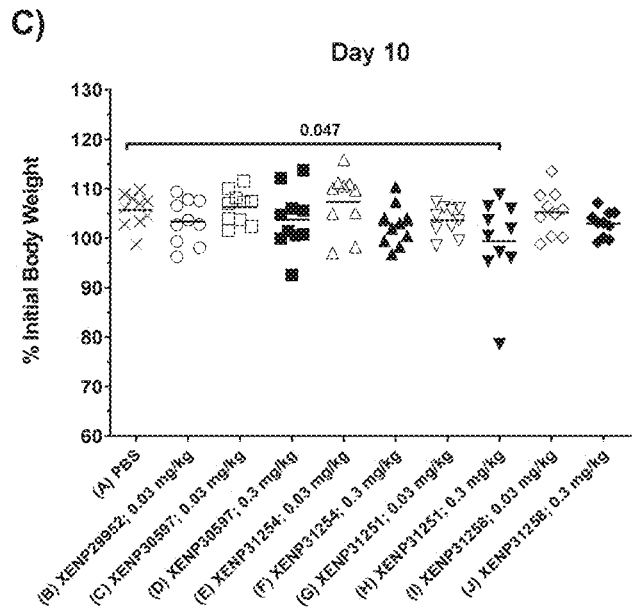
Figure 58D:
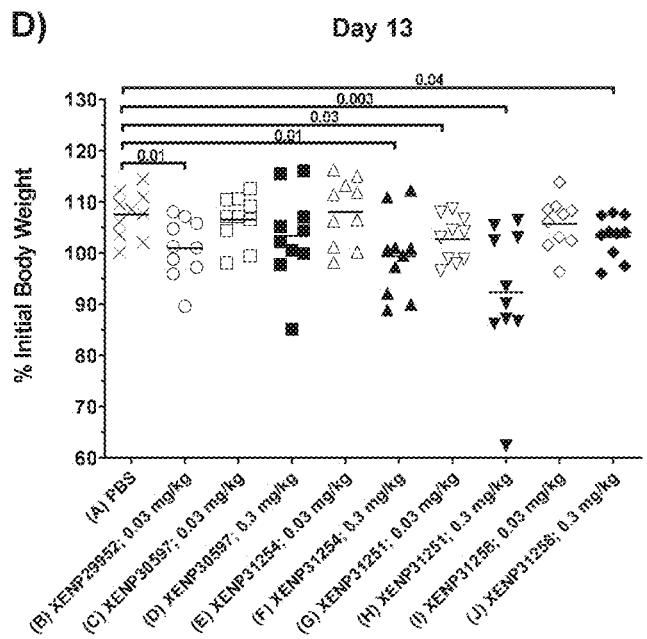
Figure 58E:
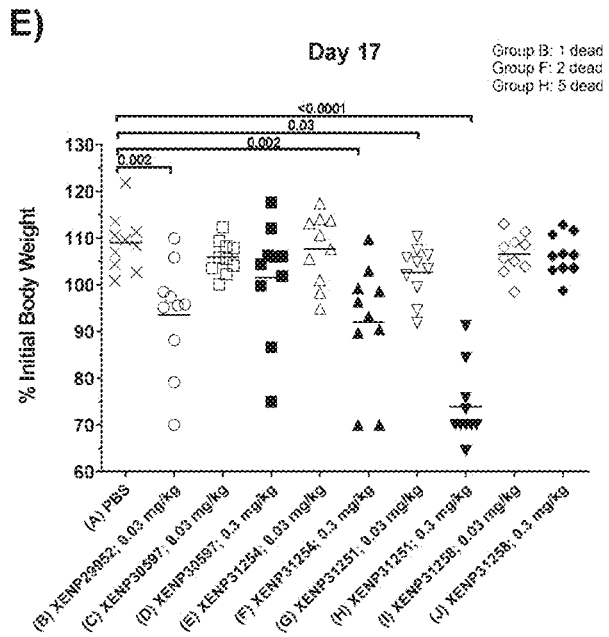
Figure 58F:
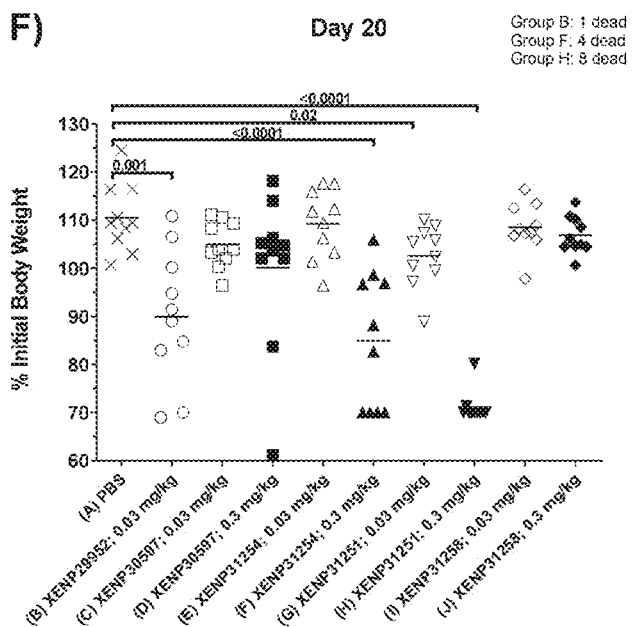
Figure 58G:
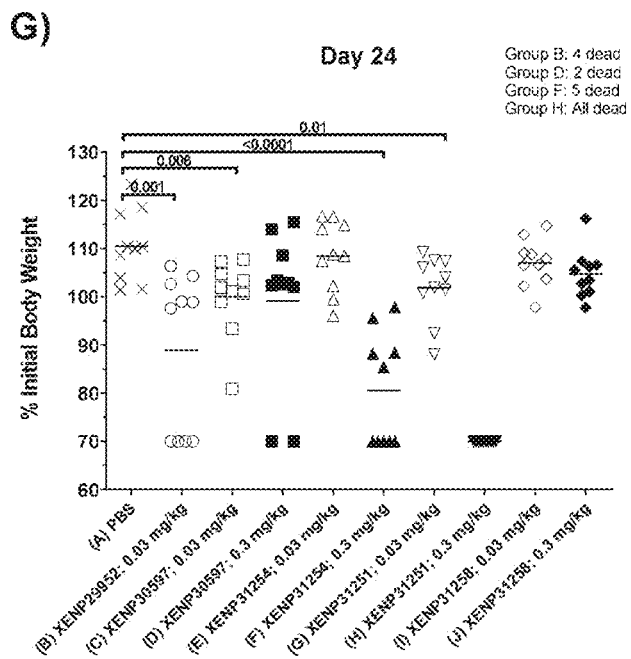
Figure 58H:
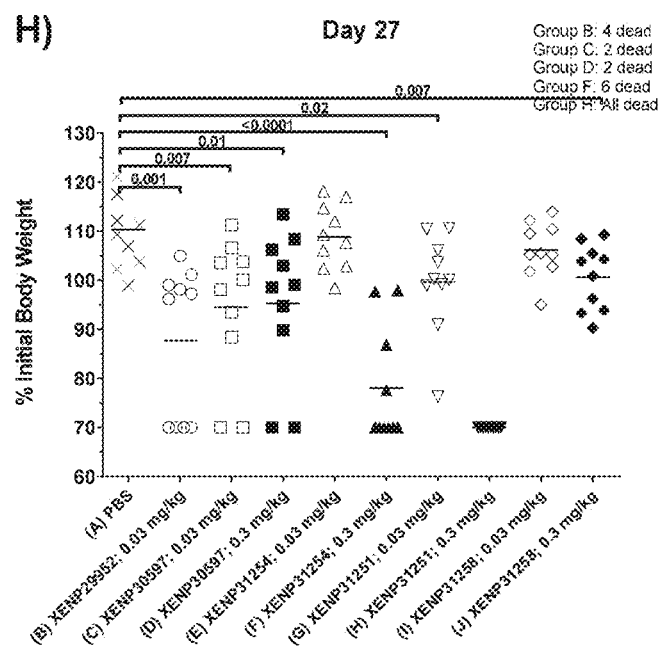
Figure 58I:
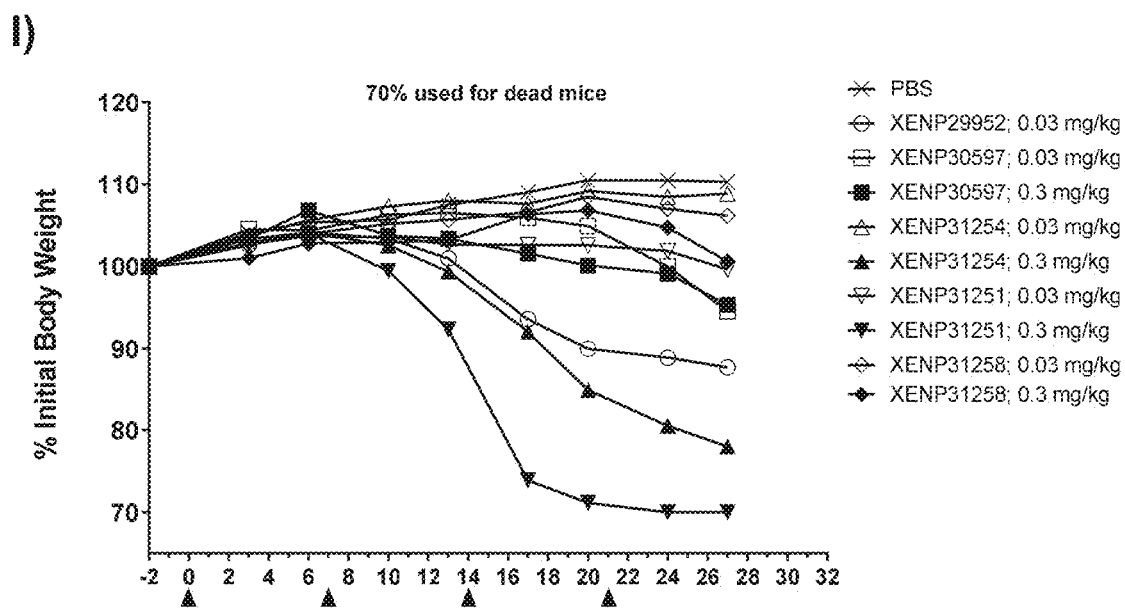

FIG. 41A and FIG. 41B depict STAT4 phosphorylation on A) CD4$^+$CD45RA$^+$CD25$^+$ T cells and B) CD8$^+$CD45RA$^+$CD25$^+$ T cells following incubation of activated PBMCs with IL-12-Fc fusions comprising Il-12p40 and/or IL-12p35 variants engineered with an aim to reduce affinity and potency.

FIG. 42 depicts the EC50 (for STAT4 phosphorylation) of IL-12-Fc fusions comprising IL-12p40 and/or IL-12p35 variants and the fold decrease in EC50 relative to WT IL-12-Fc XENP27201. The data show that potency was reduced by up to 100-fold.

FIG. 43A and FIG. 43B depict sequences for illustrative IL-12p40 variants designed with the view to reduce the affinity of the IL-12 heterodimeric complex for the IL-12 receptors. Modified amino acids are underlined and in bold.

FIG. 44 depicts sequences for illustrative IL-12p35 variants designed with the view to reduce the affinity of the IL-12 heterodimeric complex for the IL-12 receptors. Modified amino acids are underlined and in bold.

FIG. 45A-FIG. 45I depict sequences for illustrative variant IL-12-Fc fusions designed with the view to reduce the affinity of the IL-12-Fc fusions for IL-12 receptors. Linkers are double underlined (although as will be appreciated by those in the art, the linkers can be replaced by other linkers, some of which are depicted in FIG. 6), and slashes (/) indicate the border(s) between IL-12p35, IL-12p40, linkers, and Fc regions.

FIG. 46A-FIG. 46C depict sequences for illustrative variant IL-12-Fc fusions designed with the view to reduce the affinity of the IL-12-Fc fusions for IL-12 receptors, further engineered with Xtend Fc (M428L/N434S) for extending half-life. Linkers are double underlined (although as will be appreciated by those in the art, the linkers can be replaced by other linkers, some of which are depicted in FIG. 6), and slashes (/) indicate the border(s) between IL-12p35, IL-12p40, linkers, and Fc regions. It should be noted that these sequences are provided for illustrative purposes, and that any of the sequences depicted in the other Figures may also include Xtend Fc (M428L/N434S) for extending half-life.

FIG. 47A-FIG. 47D depict STAT4 phosphorylation on A) CD4$^+$CD45RA$^+$CD25$^+$ T cells, B) CD4$^+$CD45RA$^-$CD25$^+$ T cells, C) CD8$^+$CD45RA$^+$CD25$^+$ T cells, and D) CD8$^+$CD45RA$^-$ CD25$^+$ T cells following incubation of activated PBMCs with IL-12-Fc fusions comprising IL-12p40 and/or IL-12p35 variants engineered with an aim to reduce affinity and potency.

FIG. 48 depicts the EC50 (for STAT4 phosphorylation) of IL-12-Fc fusions comprising IL-12p40 and/or IL-12p35 variants and the fold decrease in EC50 relative to WT IL-12-Fc XENP27201.

FIGS. 49A-FIG. 49D depict illustrative formats for bivalent IL-12-Fc fusion proteins of the present invention. The bivalent N-terminal single-chain (FIG. 49A-FIG. 49B) format comprises two identical monomers each comprising a scIL-12 complex recombinant fused to the N-terminus of a homodimeric Fc chain (optionally via a domain linker). The bivalent C-terminal single-chain (FIG. 49C-FIG. 49D) format comprises two identical monomers each comprising a scIL-12 complex recombinant fused to the C-terminus of a homodimeric Fc chain (optionally via a domain linker). The scIL-12 complex can comprise either IL-12p35 N-terminally linked to IL-12p40 or IL-12p40 N-terminally linked to IL-12p35, optionally with a domain linker. The order of the two subunits in the scIL-12 complex may be designated as follows: "scIL-12(p40/p35)", wherein the IL-12p40 subunit is N-terminally linked to the IL-12p35 subunit, or "scIL-12 (p35/p40)", wherein the IL-12p35 is N-terminally linked to the IL-12p40 subunit.

FIG. 50 depicts the sequences for XENP31289 and XENP31291, illustrative IL-12-Fc fusion proteins of the (scIL-12(p40/p35))$_2$-Fc format. XENP31289 contains the wildtype IL-12p40 and wildtype IL-12p35 subunits. XENP31291 contains the IL-12p40(E59K/K99E) variant and wildtype IL-12p35 subunits. Linkers are double underlined (although as will be appreciated by those in the art, the linkers can be replaced by other linkers, some of which are depicted in FIG. 6), and slashes (/) indicate the border(s) between IL-12p35, IL-12p40, linkers, and Fc regions.

FIG. 51 depicts the sequences for XENP31290, an illustrative IL-12-Fc fusion protein of the scIL-12(p40/p35)-Fc format, that contains the IL-12p40(E59K/K99E) variant and wildtype IL-12p35 subunits. Linkers are double underlined (although as will be appreciated by those in the art, the linkers can be replaced by other linkers, some of which are depicted in FIG. 6), and slashes (/) indicate the border(s) between IL-12p35, IL-12p40, linkers, and Fc regions.

FIG. 52A-FIG. 52D depict STAT4 phosphorylation on A) CD4$^+$CD45RA$^+$CD25$^+$ T cells, B) CD4$^+$CD45RA$^-$CD25$^+$ T cells, C) CD8$^+$CD45RA$^+$CD25$^+$ T cells, and D) CD8$^+$CD45RA$^-$ CD25$^+$ T cells following incubation of activated PBMCs with IL-12-Fc fusions in the scIL-12(p40/p35)-Fc and (scIL-12(p40/p35))$_2$-Fc formats with either WT IL-12p40 subunits or variant IL-12p40(E59K/K99E) subunits. The data show that the IL-12-Fc fusions in scIL-12 (p40/p35)-Fc and (scIL-12(p40/p35))$_2$-Fc fusions comprising variant IL-12p40(E59K/K99E) subunits demonstrated reduced potency relative to IL-12-Fc fusions comprising WT IL-12p40 subunits.

FIG. 53 depicts the EC50 (for STAT4 phosphorylation) of IL-12-Fc fusions in the scIL-12(p40/p35)-Fc and (scIL-12 (p40/p35))$_2$-Fc formats with either WT IL-12p40 subunits or variant IL-12p40(E59K/K99E) subunits.

FIG. 54 depicts the sequences for XENP16432, anti-PD-1 mAb based on nivolumab and IgG1 backbone with E233P/L234V/L235A/G236del/S267K ablation variant.

FIG. 55A-FIG. 55D depict the change in tumor volume (as determined by caliper measurements) on A) Day 11, B) Day 13, and C) Day 15 as well as D) over time in pp65-MCF7 and huPBMC-engrafted NSG mice dosed with PBS, XENP16432 (a bivalent anti-PD-1 mAb), or XENP29952 (a reduced potency IL-12-Fc fusion in the IL-12-heteroFc format comprising variant IL-12p40(E59K)). XENP29952 significantly enhanced anti-tumor activity by Day 11 as indicated by change in tumor volume (statistics performed on baseline corrected data using unpaired t-test).

FIG. 56A-FIG. 56F depict A) CD45 cell, B) CD3$^+$ T cell, C) CD4$^+$ T cell, D) CD8$^+$ T cell, E) NK cell counts as well as F) CD4$^+$ T cell to CD8$^+$ T cell ratio in pp65-MCF7 and huPBMC-engrafted NSG mice on Day 14 following PBMC-engraftment and first dose of PBS, XENP16432 (a bivalent anti-PD-1 mAb), or XENP29952 (a reduced potency IL-12-Fc fusion in the IL-12-heteroFc format comprising variant IL-12p40(E59K)). XENP29952 had significantly enhanced expansion of CD45+, CD3+ T cells, CD4+ T cells, CD8+ T cells, and NK cells by Day 14 in comparison to both PBS control and checkpoint blockade by XENP16432 (statistics performed on log-transformed data using unpaired t-test).

FIG. 57A-FIG. 57D depict serum IFNγ concentrations on A) Day 7 and B) Day 14, and serum CD25 concentrations on C) Day 7 and D) Day 14 in pp65-MCF7 and huPBMC-engrafted NSG mice following PBMC-engraftment and first dose of PBS, XENP16432 (a bivalent anti-PD-1 mAb), or XENP29952 (a reduced potency IL-12-Fc fusion in the IL-12-heteroFc format comprising variant IL-12p40 (E59K)). XENP29952 significantly enhanced secretion of IFNγ and CD25 by Day 7 in comparison to checkpoint blockade by XENP16432 (statistics performed on log-transformed date using unpaired t-test).

FIG. 58A-FIG. 58I depict change in body weight (as an indicator of GVHD) by A) Day 3, B) Day 6, C) Day 10, D) Day 13, E) Day 17, F) Day 20, G) Day 24, and H) Day 27, as well as I) over time in huPBMC-engrafted NSG mice dosed with PBS or XENP29952 (a reduced potency IL-12-Fc fusion in the IL-12-heteroFc format comprising variant IL-12p40(E59K)), XENP30597 (a reduced potency IL-12-Fc fusion in the IL-12-heteroFc format comprising variant IL-12p40(E59K/K99E)), XENP31254 (a reduced potency IL-12-Fc fusion in the IL-12-heteroFc format comprising variant IL-12p40(D18K/E59K/K99E)), XENP31251 (a reduced potency IL-12-Fc fusion in the IL-12-heteroFc format comprising variant IL-12p40(E59K/K99Y)), or XENP31258 (a reduced potency IL-12-Fc fusion in the IL-12-heteroFc format comprising variant IL-12p40(E59K/K99E/K264E)) at 0.3 or 0.03 mg/kg. Notably, the IL-12-Fc fusion test articles induced varying degrees of GVHD which correlated with their in vitro potency. Additionally, the data show a dose response for the test articles (i.e. enhanced GVHD by 0.3 mg/kg vs. 0.03 mg/kg).

Figure 59A:
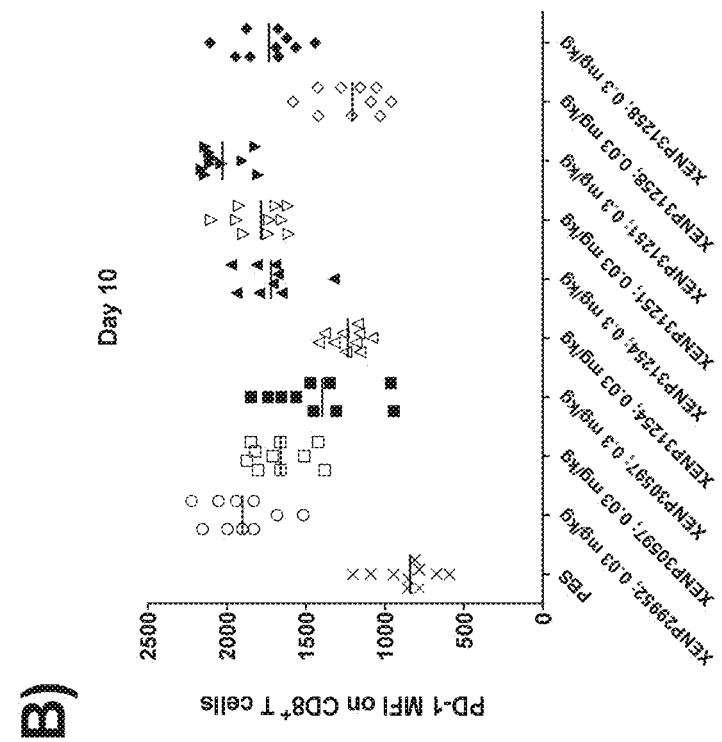
Figure 59B:
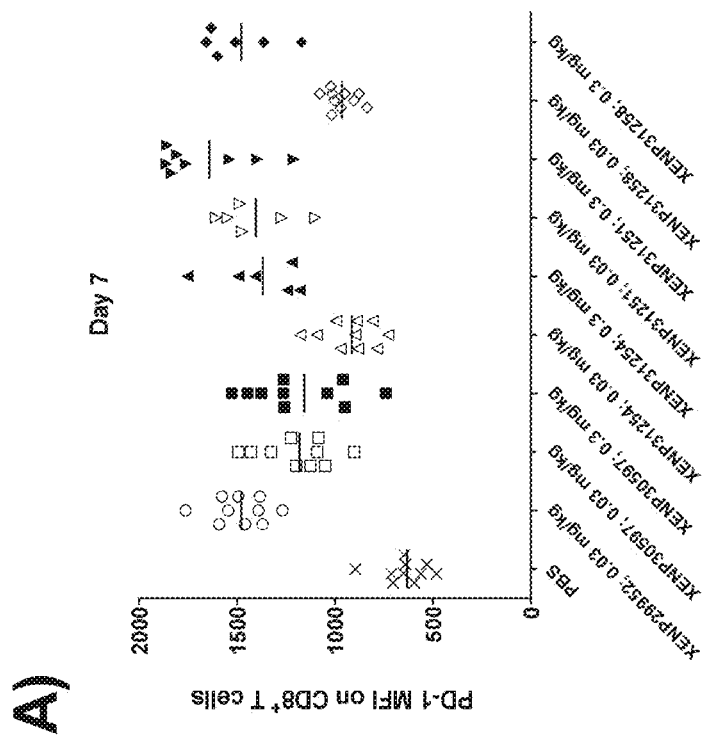
Figure 59C:
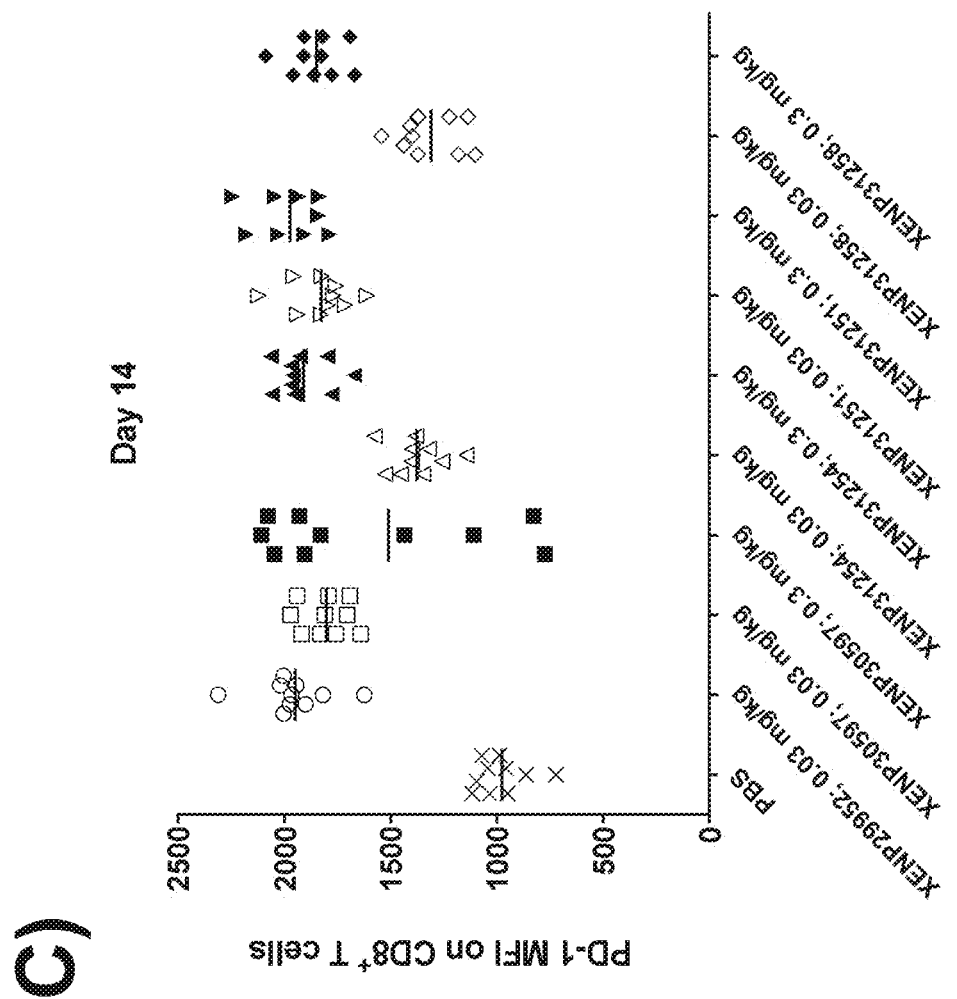
Figure 61A:
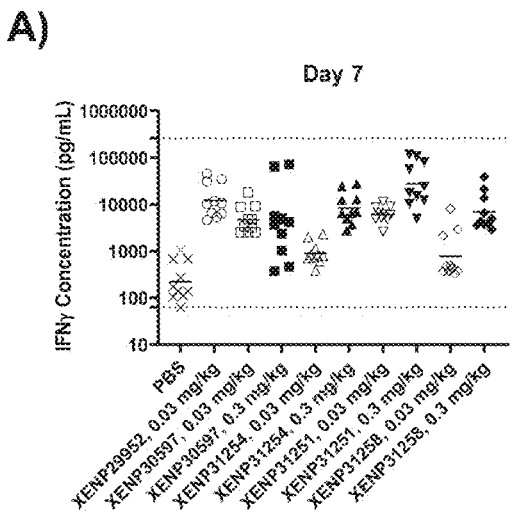
Figure 61B:
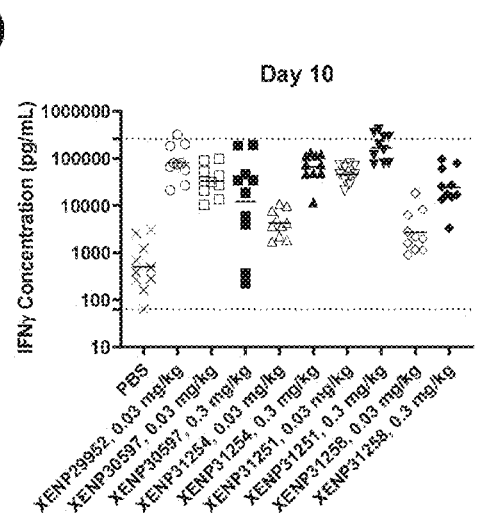
Figure 61C:
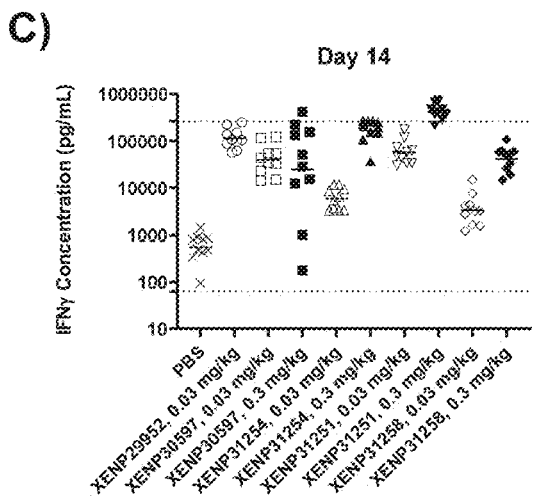
Figure 61D:
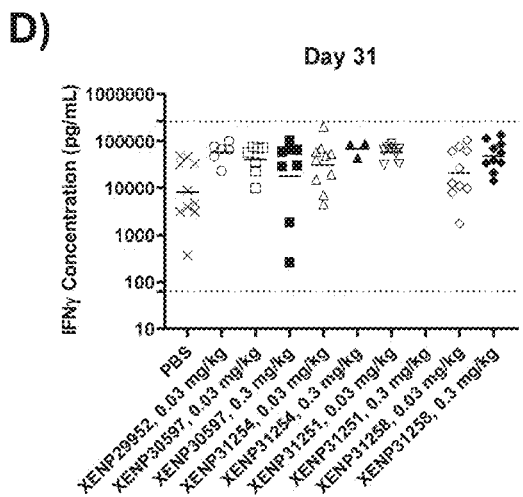
Figure 62D:
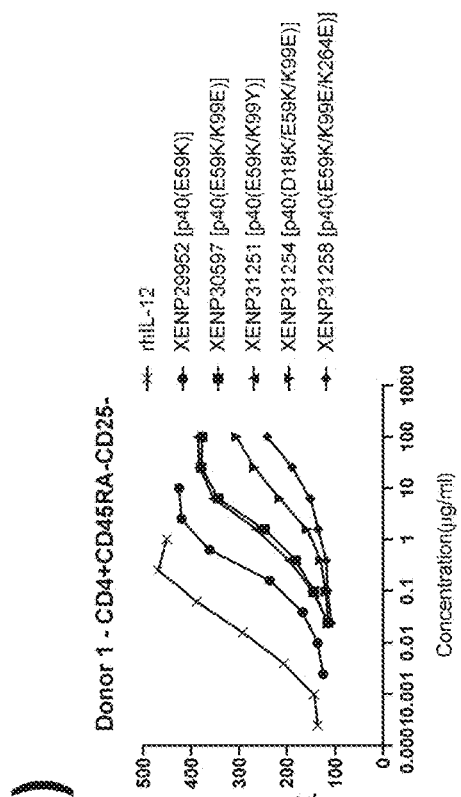
Figure 62C:
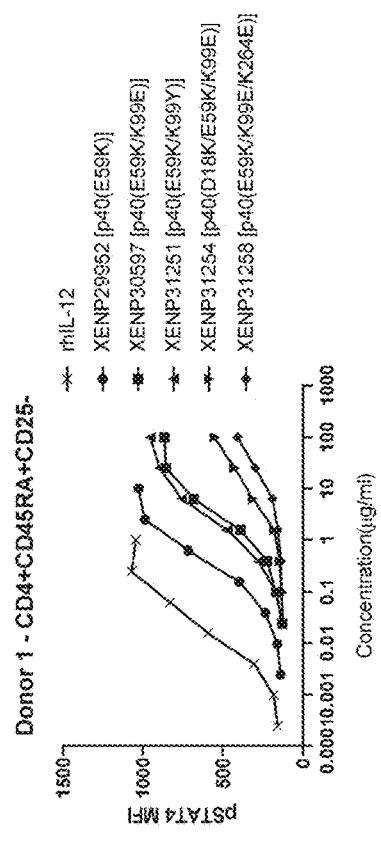
Figure 62E:
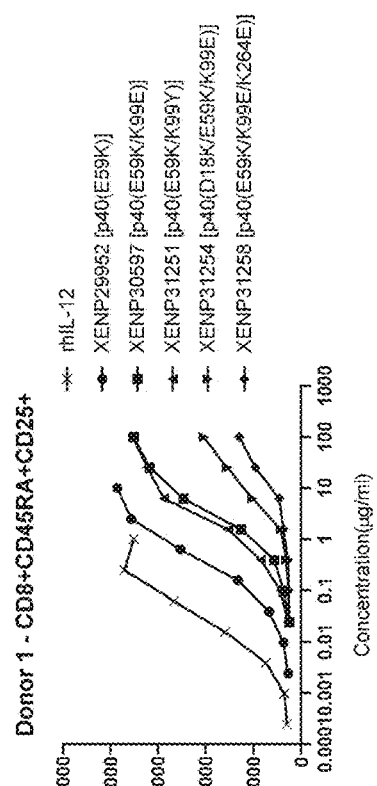
Figure 62F:
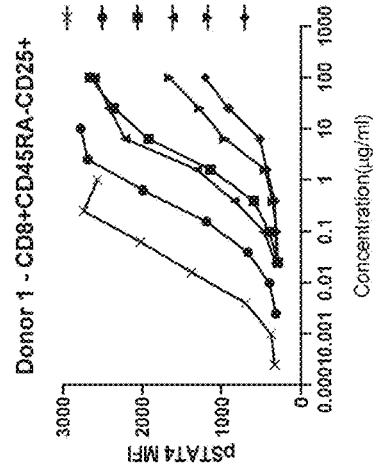
Figure 62G:
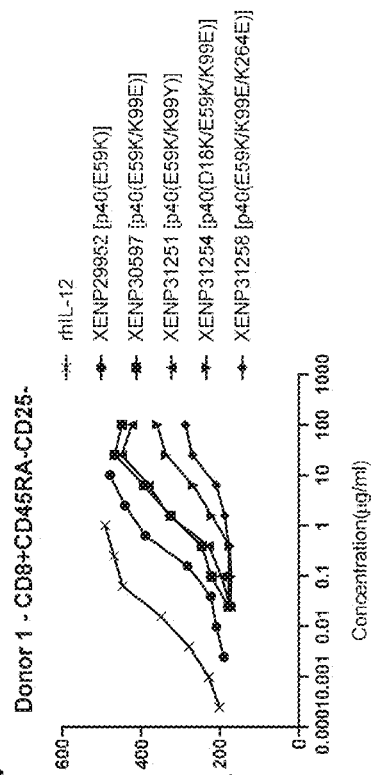
Figure 62H:
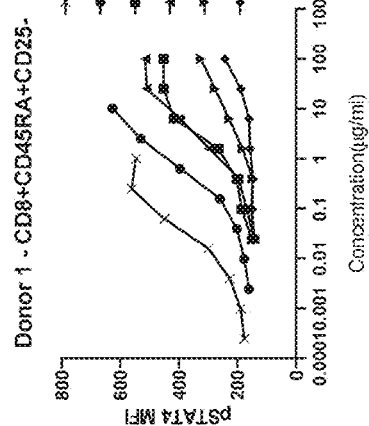
Figure 63A:
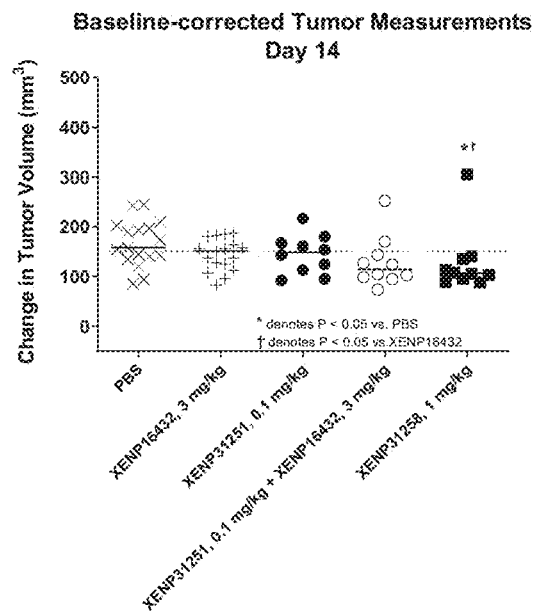
Figure 63B:
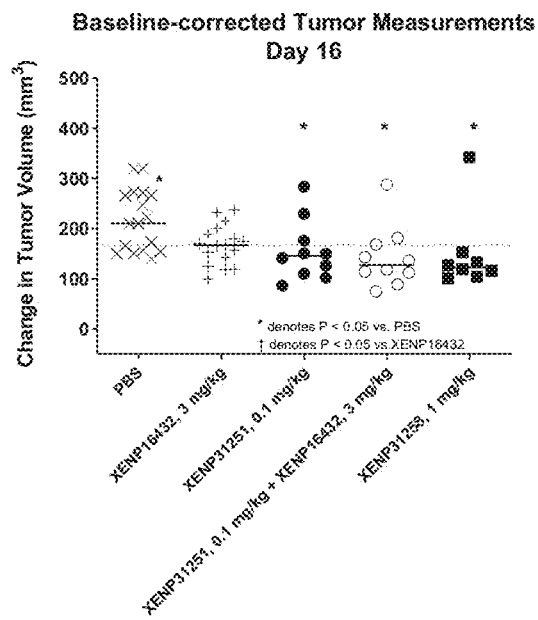
Figure 63C:
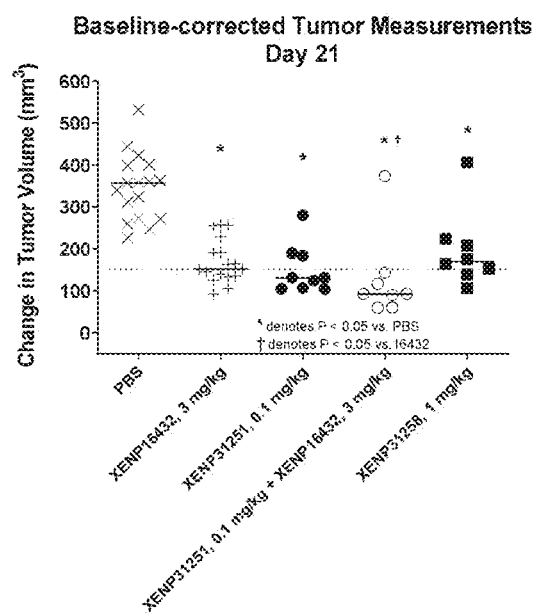
Figure 63D:
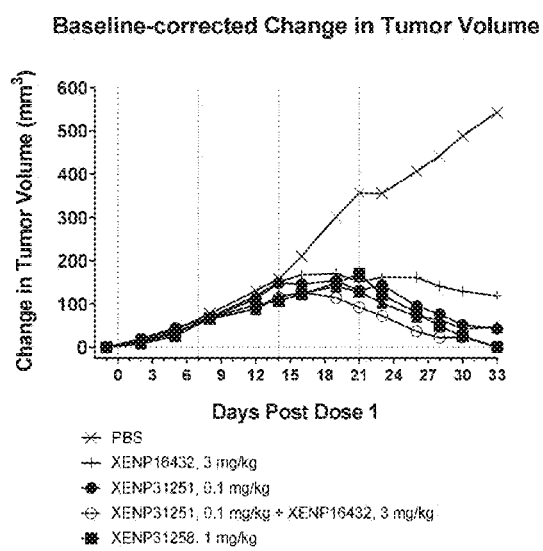
Figure 64B:
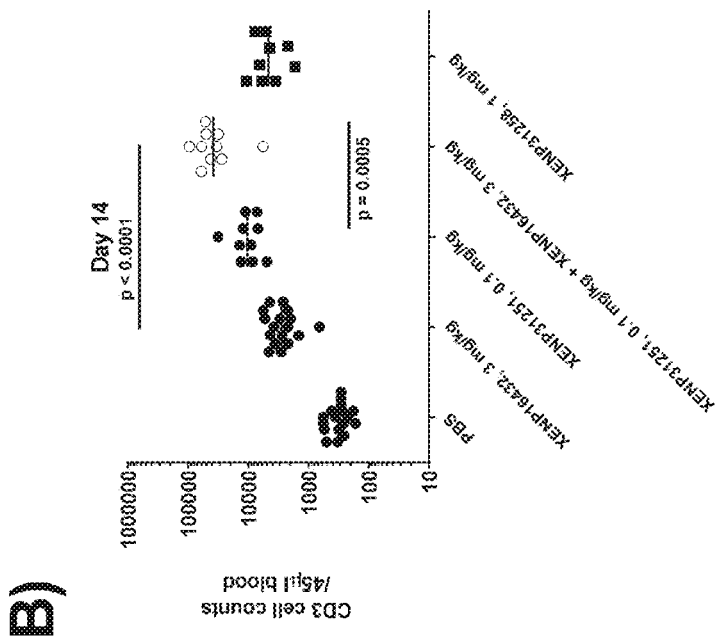
Figure 64A:
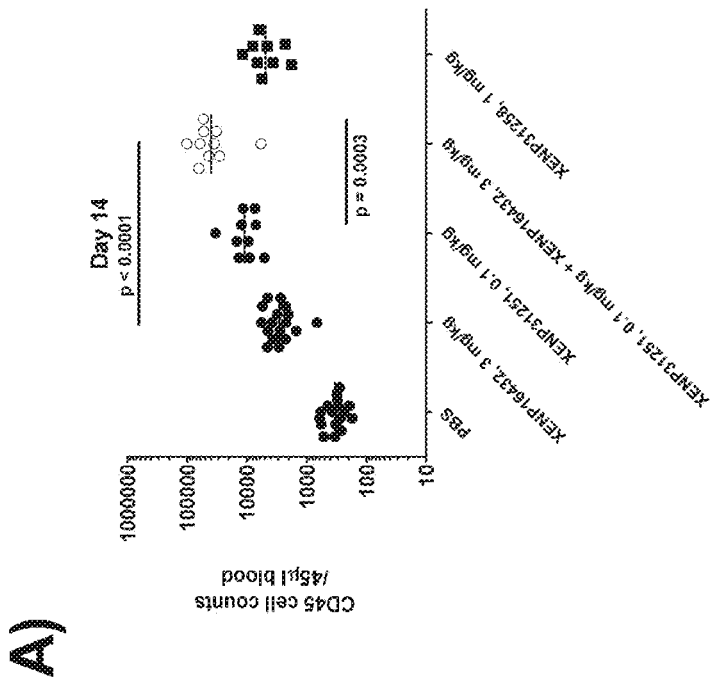
Figure 64D:
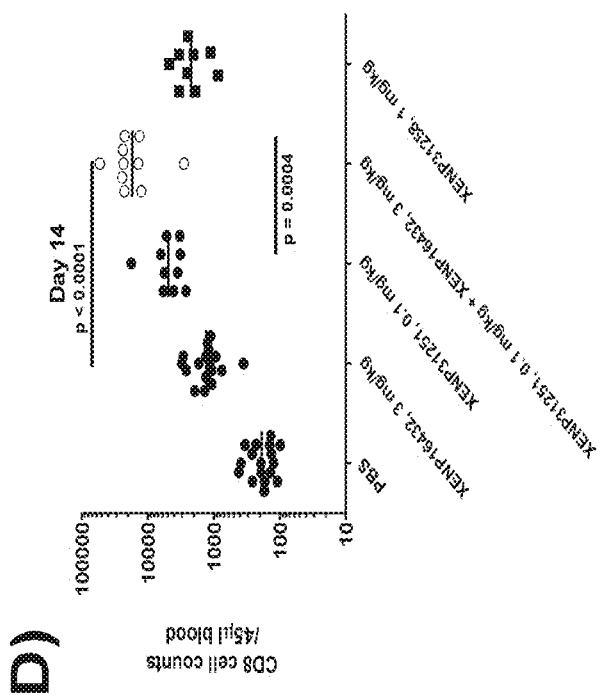
Figure 64C:
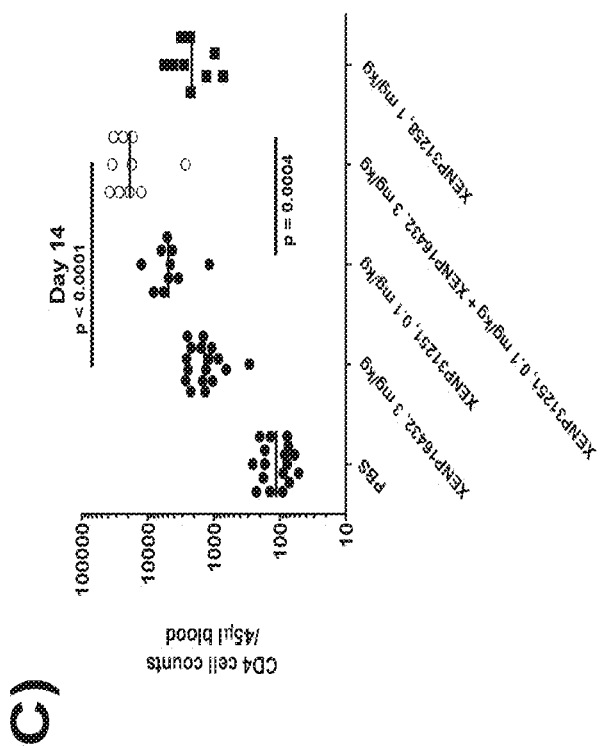
Figure 64F:
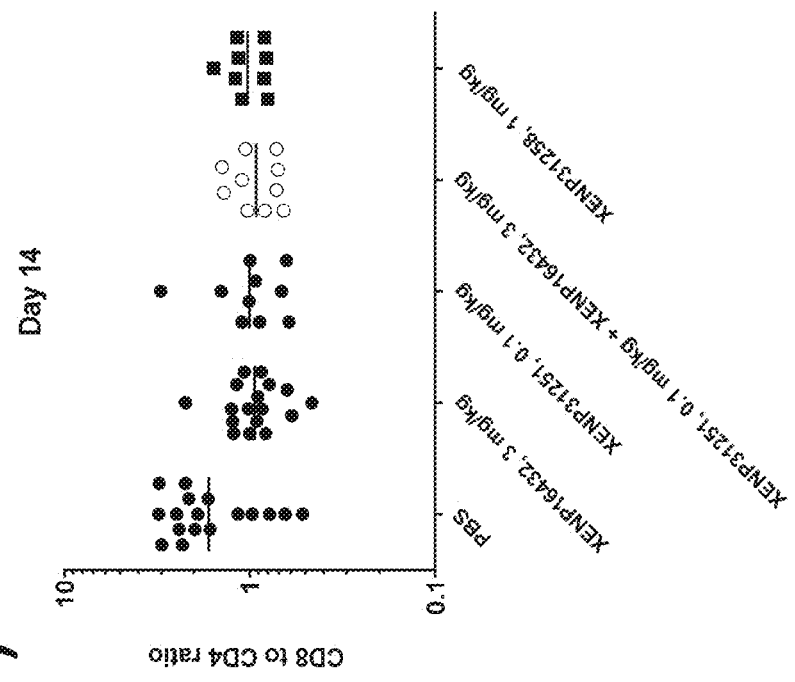
Figure 64E:
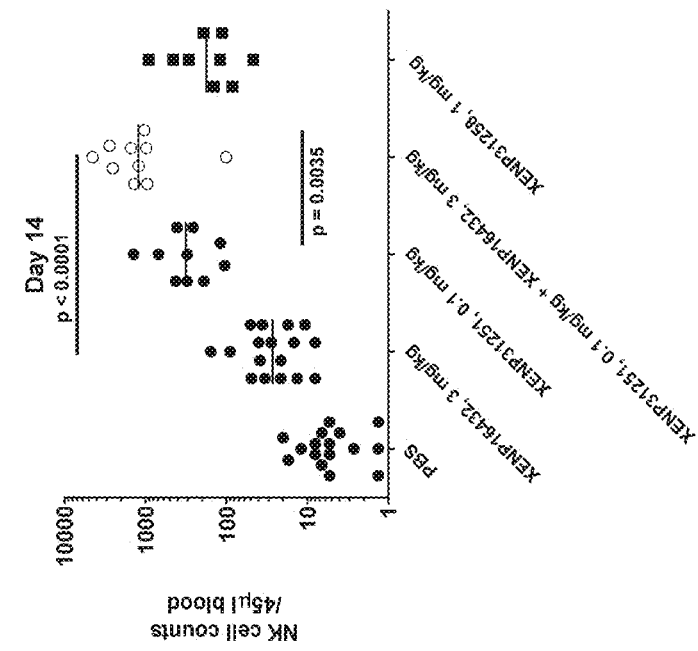
Figure 68A:
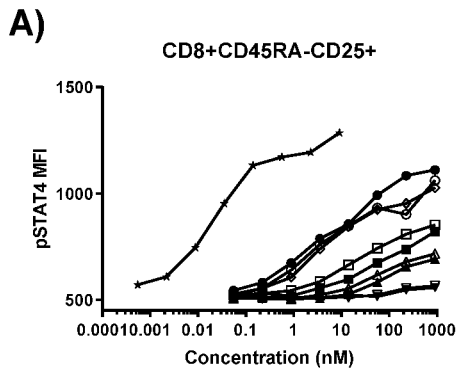
Figure 68B:
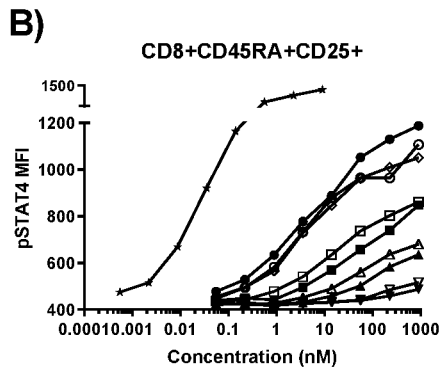
Figure 68C:
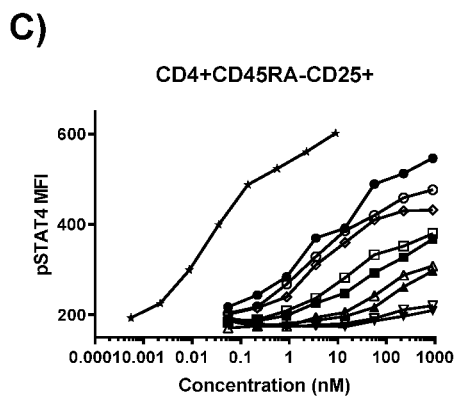
Figure 68D:
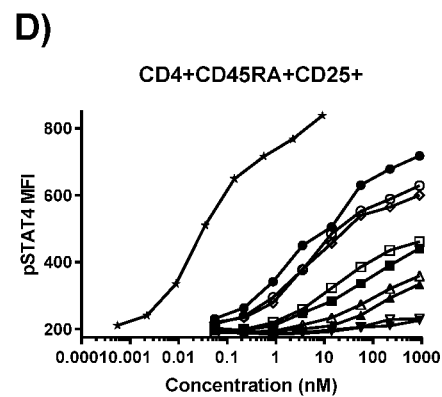
Figure 68E:
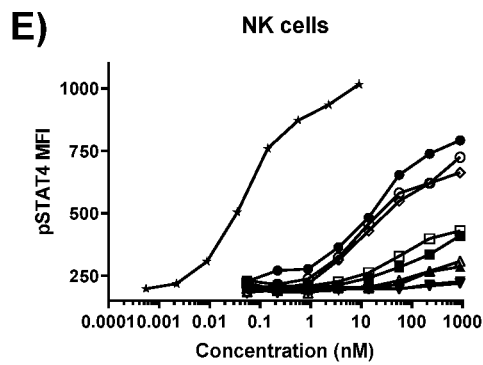

FIG. 59A-FIG. 59C depict PD-1 expression on CD8+ T cells (as an indicator of activation) in huPBMC-engrafted NSG mice on A) Day 7, B) Day 10, and C) Day 14 following PBMC-engraftment and first dose of PBS or XENP29952 (a reduced potency IL-12-Fc fusion in the IL-12-heteroFc format comprising variant IL-12p40(E59K)), XENP30597 (a reduced potency IL-12-Fc fusion in the IL-12-heteroFc format comprising variant IL-12p40(E59K/K99E)), XENP31254 (a reduced potency IL-12-Fc fusion in the IL-12-heteroFc format comprising variant IL-12p40(D18K/E59K/K99E)), XENP31251 (a reduced potency IL-12-Fc fusion in the IL-12-heteroFc format comprising variant IL-12p40(E59K/K99Y)), or XENP31258 (a reduced potency IL-12-Fc fusion in the IL-12-heteroFc format comprising variant IL-12p40(E59K/K99E/K264E)) at 0.3 or 0.03 mg/kg. Notably, the IL-12-Fc fusion test articles induced varying degrees of CD8+ T cell activation which correlated with their in vitro potency. Additionally, the data show a dose response for the test articles (i.e. enhanced CD8+ T cell activation by 0.3 mg/kg vs. 0.03 mg/kg).

FIG. 60A-FIG. 60C depict PD-1 expression on CD4+ T cells (as an indicator of activation) in huPBMC-engrafted NSG mice on A) Day 7, B) Day 10, and C) Day 14 following PBMC-engraftment and first dose of PBS or XENP29952 (a reduced potency IL-12-Fc fusion in the IL-12-heteroFc format comprising variant IL-12p40(E59K)), XENP30597 (a reduced potency IL-12-Fc fusion in the IL-12-heteroFc format comprising variant IL-12p40(E59K/K99E)), XENP31254 (a reduced potency IL-12-Fc fusion in the IL-12-heteroFc format comprising variant IL-12p40(D18K/E59K/K99E)), XENP31251 (a reduced potency IL-12-Fc fusion in the IL-12-heteroFc format comprising variant IL-12p40(E59K/K99Y)), or XENP31258 (a reduced potency IL-12-Fc fusion in the IL-12-heteroFc format comprising variant IL-12p40(E59K/K99E/K264E)) at 0.3 or 0.03 mg/kg. Notably, the IL-12-Fc fusion test articles induced varying degrees of CD4+ T cell activation which correlated with their in vitro potency. Additionally, the data show a dose response for the test articles (i.e. enhanced CD4+ T cell activation by 0.3 mg/kg vs. 0.03 mg/kg).

FIG. 61A-FIG. 61D depict serum concentration of IFNγ in huPBMC-engrafted NSG mice on Days A) 7, B) 10, C) 14 and D) 31 following PBMC-engraftment and first dose of PBS or XENP29952 (a reduced potency IL-12-Fc fusion in the IL-12-heteroFc format comprising variant IL-12p40 (E59K)), XENP30597 (a reduced potency IL-12-Fc fusion in the IL-12-heteroFc format comprising variant IL-12p40 (E59K/K99E)), XENP31254 (a reduced potency IL-12-Fc fusion in the IL-12-heteroFc format comprising variant IL-12p40(D18K/E59K/K99E)), XENP31251 (a reduced potency IL-12-Fc fusion in the IL-12-heteroFc format comprising variant IL-12p40(E59K/K99Y)), or XENP31258 (a reduced potency IL-12-Fc fusion in the IL-12-heteroFc format comprising variant IL-12p40(E59K/K99E/K264E)) at 0.3 or 0.03 mg/kg. Notably, the IL-12-Fc fusion test articles induced varying levels of IFNγ secretion which correlated with their in vitro potency. Additionally, the data show a dose response for the test articles (i.e. enhanced IFNγ secretion induced by 0.3 mg/kg vs. 0.03 mg/kg).

FIG. 62A-FIG. 62K depict STAT4 phosphorylation on A) CD4+CD45RA−CD25+ T cells, B) CD4+CD45RA+CD25+ T cells, C) CD4+CD45RA+CD25− T cells, D) CD4+CD45RA−CD25− T cells, E) CD8+CD45RA−CD25+ T cells, F) CD8+CD45RA+CD25+ T cells, G) CD8+CD45RA+CD25− T cells, H) CD8+CD45RA−CD25− T cells, I) Tregs, J) γδ T cells, and K) CD56+ NK cells following incubation of activated PBMCs (from a second donor; Donor 2) with recombinant human IL-12, XENP29952 (a reduced potency IL-12-Fc fusion in the IL-12-heteroFc format comprising variant IL-12p40(E59K)), XENP30597 (a reduced potency IL-12-Fc fusion in the IL-12-heteroFc format comprising variant IL-12p40(E59K/K99E)), XENP31254 (a reduced potency IL-12-Fc fusion in the IL-12-heteroFc format comprising variant IL-12p40(D18K/E59K/K99E)), XENP31251 (a reduced potency IL-12-Fc fusion in the IL-12-heteroFc format comprising variant IL-12p40(E59K/K99Y)), or XENP31258 (a reduced potency IL-12-Fc fusion in the IL-12-heteroFc format comprising variant IL-12p40(E59K/K99E/K264E)). The data show a potency ladder with XENP29952 as the most potent variant, XENP31254 and XENP31258 as the least potent variants, and XENP30597 and XENP31251 falling in between. Notably, the degree of GVHD and T cell activation as induced by the reduced potency IL-12-Fc fusion variants in vivo correlated with the in vitro potency.

FIG. 63A-FIG. 63D depict the change in tumor volume (as determined by caliper measurements) on A) Day 14, B) Day 16, and C) Day 21 as well as D) over time in pp65-MCF7 and huPBMC-engrafted NSG mice dosed with PBS, XENP16432 (a bivalent anti-PD-1 mAb), XENP31258, XENP31251, or a combination of XENP31251 and XENP16432. XENP31258 significantly enhanced anti-tumor activity by Day 14, XENP31251 (alone or in combination with XENP16432) significantly enhanced anti-tumor activity by Day 16 in comparison to treatment with PBS; and XENP31251 in combination with XENP16432 significantly enhanced anti-tumor activity by Day 21 in comparison to treatment with XENP16432 alone (statistics performed on baseline corrected data using Mann-Whitney test).

FIG. 64A-FIG. 64F depict A) CD45 cell, B) CD3+ T cell, C) CD4+ T cell, D) CD8+ T cell, E) NK cell counts as well as F) CD8+ T cell to CD4+ T cell ratio in pp65-MCF7 and huPBMC-engrafted NSG mice on Day 14 following PBMC-engraftment and first dose of PBS, XENP16432 (a bivalent anti-PD-1 mAb), XENP31258, XENP31251, or a combination of XENP31251 and XENP16432. Notably, the data show that treatment with XENP31251 in combination with XENP16432 significantly enhanced lymphocyte expansion in comparison to either XENP31251 or XENP16432 alone, indicating that IL-12-Fc fusions combine productively with checkpoint blockade.

FIG. 65A-FIG. 65B depict sequences for illustrative variant IL-12-Fc fusions designed with the view to reduce the affinity of the IL-12-Fc fusions for IL-12 receptors, further engineered with Xtend Fc (M428L/N434S) for extending half-life. Linkers are double underlined (although as will be appreciated by those in the art, the linkers can be replaced by other linkers, some of which are depicted in FIG. 6), and slashes (/) indicate the border(s) between I1-12p35, IL-12p40, linkers, and Fc regions. It should be noted that these sequences are provided for illustrative purposes, and that any of the sequences depicted in the other Figures may also include Xtend Fc (M428L/N434S) for extending half-life.

FIG. 66A-FIG. 66C depicts sequences for illustrative IL-12p40 variants engineered with C252S with the view to remove the free cysteine (in addition to expression and affinity/potency variants).

FIG. 67A-FIG. 67N depict sequences for illustrative variant IL-12-Fc fusions engineered with C252S in the IL-12p40 subunit with the view to remove the free cysteine (in addition to expression and affinity/potency variants). Linkers are double underlined (although as will be appreciated by those in the art, the linkers can be replaced by other linkers, some of which are depicted in FIG. 6), and slashes (/) indicate the border(s) between IL-12p35, IL-12p40, linkers, and Fc regions.

FIG. 68A-FIG. 68E depict STAT4 phosphorylation on A) CD8+CD45RA-CD25+ T cells, B) CD8+CD45RA+CD25+ T, C) CD4+CD45RA–CD25+ T, D) CD4+CD45RA+CD25+ T, and E) NK cells following incubation of activated PBMCs with IL-12-Fc comprising IL-12p40 variants with or without additional engineering to remove free cysteine. The data show that most of the variants comprising C252S in the IL-12p40 subunit demonstrated similar, albeit slightly improved, potency in comparison to the variants without the C252S modification.

FIG. 69 depicts the antigen sequences for a number of antigens of use in the invention, including both human and cyno, to facilitate the development of antigen binding domains that bind to both for ease of clinical development.

FIG. 70A-FIG. 70I depict the sequences for the variable heavy and variable light chains for illustrative anti-PD-1 ABDs which find use in the targeted IL-12-Fc fusions of the invention. The CDRs are underlined. As noted herein and is true for every sequence herein containing CDRs, the exact identification of the CDR locations may be slightly different depending on the numbering used as is shown in Table 1, and thus included herein are not only the CDRs that are underlined but also CDRs included within the $V_H$ and $V_L$ domains using other numbering systems.

FIG. 71 depicts the sequences for XENP21575, a chimeric and humanized anti-PD-1 antibodies based on the variable regions of hybridoma clone 1C11 and human IgG1 with E233P/L234V/L235A/G236del/S267K substitutions in the heavy chain. The CDRs are underlined, and the slashes indicate the borders of the variable domains. As note herein and is true for every sequence herein containing CDRs, the exact identification of the CDR locations may be slightly different depending on numbering used as is shown in Table 1, and thus included herein are not only the CDRs that are underlined but also CDRs included within the $V_H$ and $V_L$ domains using other numbering systems. As will be appreciated by those in the art, the $V_H$ and $V_L$ domains can be formatted as Fab or scFvs for use in the PD-1-targeted IL-12-Fc fusion proteins of the invention.

FIG. 72 depicts the sequences for illustrative humanized variants of anti-PD-1 mAb A, mAb B, and mAb C in bivalent human IgG1 format with E233P/L234V/L235A/G236del/S267K substitutions in the heavy chain. The CDRs are underlined, and the slashes indicate the borders of the variable domains. As note herein and is true for every sequence herein containing CDRs, the exact identification of the CDR locations may be slightly different depending on numbering used as is shown in Table 1, and thus included herein are not only the CDRs that are underlined but also CDRs included within the $V_H$ and $V_L$ domains using other numbering systems. As will be appreciated by those in the art, the $V_H$ and $V_L$ domains can be formatted as Fab or scFvs for use in the PD-1-targeted IL-12-Fc fusion proteins of the invention.

FIG. 73 depicts epitope binning of XENP16432 (a bivalent anti-PD-1 mAb based on nivolumab), XENP21461 (pembrolizumab), chimeric mAb A (chmAb A), chimeric mAb B (chmAb B), chimeric mAb C, and a 1C11-based mAb as indicated by normalized BLI-response Octet. Normalized BLI-response greater than 0.5 indicate that an antibody pair does not bin to the same epitope.

Figure 74A:
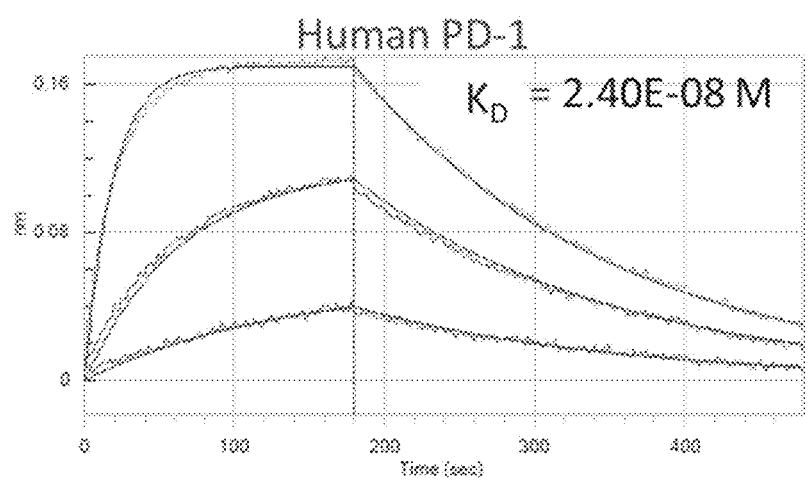
Figure 74B:
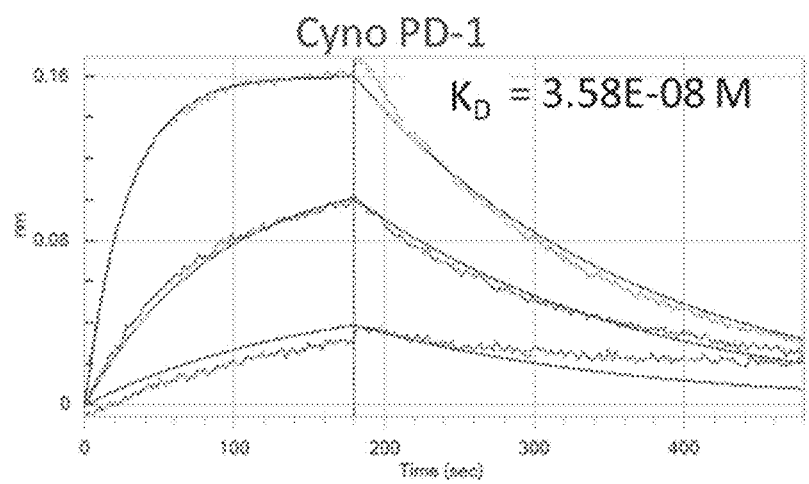

FIG. 74A and FIG. 74B depict the affinity of XENP28536 for A) human PD-1 and B) cynomolgus PD-1 as determined by Octet (as well as the associated sensorgram).

FIG. 75A-FIG. 75I depict apparent dissociation constant ($K_{Dapp}$), association rate ($k_a$), and dissociation rate ($k_d$) of affinity-engineered mAb C[PD-1]_H1L1 variants (in bivalent IgG1 format with E233P/L234V/L235A/G236_/S267K ablation variants) as determined by Octet, as well as fold improvement over mAb C[PD-1]_H1L1. Substitutions in variable heavy or variable light regions, where listed, are based on Xencor numbering (with corresponding Kabat position listed in the next column). Out of 304 variants having single point mutation in either the variable heavy or the variable light region, we only identified 11 variants (including mAb C[PD-1]_H1_L1.1 and mab_C[PD-1]_H1_L1.3) having greater than 2-fold improved affinity over WT.

FIG. 76A-FIG. 76J depict the sequences for the variable heavy and variable light chains for illustrative anti-PD-L1 ABDs which find use in the targeted IL-12-Fc fusions of the invention. The CDRs are underlined. As noted herein and is true for every sequence herein containing CDRs, the exact identification of the CDR locations may be slightly different depending on the numbering used as is shown in Table 1, and thus included herein are not only the CDRs that are underlined but also CDRs included within the $V_H$ and $V_L$ domains using other numbering systems.

FIG. 77 shows the sequences of several useful targeting IL-12-Fc fusion format backbones based on human IgG1, without the cytokine sequences (e.g. the IL12p40 and/or IL12p35 subunits) or VH, and further excluding light chain backbones which are depicted in FIG. 78. Backbone 1 is based on human IgG1 (356E/358M allotype), and includes the S364K/E357Q:L368D/K370S skew variants, C220S and the Q295E/N384D/Q418E/N421D pI variants on the chain with L368D/K370S skew variants and the E233P/L234V/L235A/G236del/S267K ablation variants on both chains. Backbone 2 is based on human IgG1 (356E/358M allotype), and includes the S364K/E357Q:L368D/K370S skew variants, the N208D/Q295E/N384D/Q418E/N421D pI variants on the chain with L368D/K370S skew variants, C220S in the chain with S364K/E357Q variants, and the E233P/L234V/L235A/G236del/S267K ablation variants on both chains. Backbone 3 is based on human IgG1 (356E/358M allotype), and includes the S364K/E357Q:L368D/K370S skew variants, the N208D/Q295E/N384D/Q418E/N421D pI variants on the chains with L368D/K370S skew variants, the Q196K/I199T/P217R/P228R/N276K pI variants on the chains with S364K/E357Q variants, and the E233P/L234V/L235A/G236del/S267K ablation variants on both chains.

In certain embodiments, these sequences can be of the 356D/358L allotype. In other embodiments, these sequences can include either the N297A or N297S substitutions. In some other embodiments, these sequences can include the M428L/N434S Xtend mutations. In yet other embodiments, these sequences can instead be based on human IgG4, and include a S228P (EU numbering, this is S241P in Kabat) variant on both chains that ablates Fab arm exchange as is known in the art. In yet further embodiments, these sequences can instead be based on human IgG2. Further, these sequences may instead utilize the other skew variants, pI variants, and ablation variants depicted in FIGS. 2-4.

As will be appreciated by those in the art and outlined below, any IL12p40 and/or IL12p35 variants can be incorporated in these backbones. Furthermore as will be appreciated by those in the art and outlined below, these sequences can be used with any VH and VL pairs outlined herein, including either a scFv or a Fab.

Included within each of these backbones are sequences that are 90, 95, 98 and 99% identical (as defined herein) to the recited sequences, and/or contain from 1, 2, 3, 4, 5, 6, 7, 8, 9 or 10 additional amino acid substitutions (as compared to the "parent" of the Figure, which, as will be appreciated by those in the art, already contain a number of amino acid modifications as compared to the parental human IgG1 (or IgG2 or IgG4, depending on the backbone). That is, the recited backbones may contain additional amino acid modifications (generally amino acid substitutions) in addition to the skew, pI and ablation variants contained within the backbones of this figure.

FIG. 78 depicts the "non-Fv" backbone of light chains (i.e. constant light chain) which find use in targeted IL-12-Fc fusion proteins of the invention.

FIG. 79A-FIG. 79E depict several formats for the targeted IL-12-Fc fusion proteins of the present invention. The "scIL-12×scFv" format (FIG. 79A) comprises IL12p40 fused (optionally by a variable length linker) to IL12p35 (termed scIL-12) which is then fused (optionally by a variable length linker) to the N-terminus of a heterodimeric Fc-region, with an scFv fused to the other side of the heterodimeric Fc. The "scIL-12×Fab" format (FIG. 79B) comprises IL12p40 fused (optionally by a variable length linker) to IL12p35 (termed scIL-12) which is then fused (optionally by a variable length linker) to the N-terminus of a heterodimeric Fc-region, with a variable heavy chain (VH) fused to the other side of the heterodimeric Fc, while a corresponding light chain is transfected separately so as to form a Fab with the VH. The "mAb-scIL-12" format (FIG. 79C) comprises VH fused to the N-terminus of a first and a second heterodimeric Fc, with a scIL-12 fused to the C-terminus of one of the heterodimeric Fc-regions, while corresponding light chains are transfected separately so as to form a Fab with the VH. The "central-IL-12" format (FIG. 79D) comprises a VH recombinantly fused to the N-terminus of a IL12p40 subunit which is then further fused to one side of a heterodimeric Fc and a VH recombinantly fused to the N-terminus of IL12p35 subunit which is then further fused to the other side of the heterodimeric Fc, while corresponding light chains are transfected separately so as to form a Fabs with the VHs. The "central-scIL-12" format (FIG. 79E) comprises a VH fused to the N-terminus of scIL-12 which is then further fused to one side of a heterodimeric Fc and a VH fused to the other side of the heterodimeric Fc, while corresponding light chains are transfected separately so as to form a Fabs with the VHs. It should be noted that in each of the formats, the position of the IL-12p40 subunit and IL-12p35 subunit can be swapped.

FIG. 80A-FIG. 80J depict sequences of illustrative PD-1-targeted IL-12-Fc fusion proteins of the "scIL-12×Fab" format. The CDRs are underlined. As noted herein and is true for every sequence herein containing CDRs, the exact identification of the CDR locations may be slightly different depending on the numbering used as is shown in Table 1, and thus included herein are not only the CDRs that are underlined but also CDRs included within the VH and VL domains using other numbering systems. IL-12 subunits are italicized, linkers are double underlined (although as will be appreciated by those in the art, the linkers can be replaced by other linkers, some of which are depicted in FIGS. 6 and 7), and slashes (/) indicate the border(s) between IL-12 subunits, linkers, variable regions, and constant/Fc regions. As will be clear to those skilled in the art, each of the PD-1-targeted IL-12-Fc fusion proteins described can also include Xtend Fc (M428L/N434S).

FIG. 81A and FIG. 81B depict sequences of illustrative PD-L1-targeted IL-12-Fc fusion proteins of the "scIL-12×Fab" format. The CDRs are underlined. As noted herein and is true for every sequence herein containing CDRs, the exact identification of the CDR locations may be slightly different depending on the numbering used as is shown in Table 1, and thus included herein are not only the CDRs that are underlined but also CDRs included within the $V_H$ and $V_L$ domains using other numbering systems. IL-12 subunits are italicized, linkers are double underlined (although as will be appreciated by those in the art, the linkers can be replaced by other linkers, some of which are depicted in FIGS. 6 and 7), and slashes (/) indicate the border(s) between IL-12 subunits, linkers, variable regions, and constant/Fc regions. As will be clear to those skilled in the art, each of the PD-L1-targeted IL-12-Fc fusion proteins described can also include Xtend Fc (M428L/N434S).

FIG. 82A-FIG. 82H depict sequences of illustrative RSV-targeted IL-12-Fc fusion proteins of the "scIL-12×Fab" format. The CDRs are underlined. As noted herein and is true for every sequence herein containing CDRs, the exact identification of the CDR locations may be slightly different depending on the numbering used as is shown in Table 1, and thus included herein are not only the CDRs that are underlined but also CDRs included within the VH and VL domains using other numbering systems. IL-12 subunits are italicized, linkers are double underlined (although as will be appreciated by those in the art, the linkers can be replaced by other linkers, some of which are depicted in FIGS. 6 and 7), and slashes (/) indicate the border(s) between IL-12 subunits, linkers, variable regions, and constant/Fc regions. As will be clear to those skilled in the art, each of the RSV-targeted IL-12-Fc fusion proteins described can also include Xtend Fc (M428L/N434S).

Figure 83A:
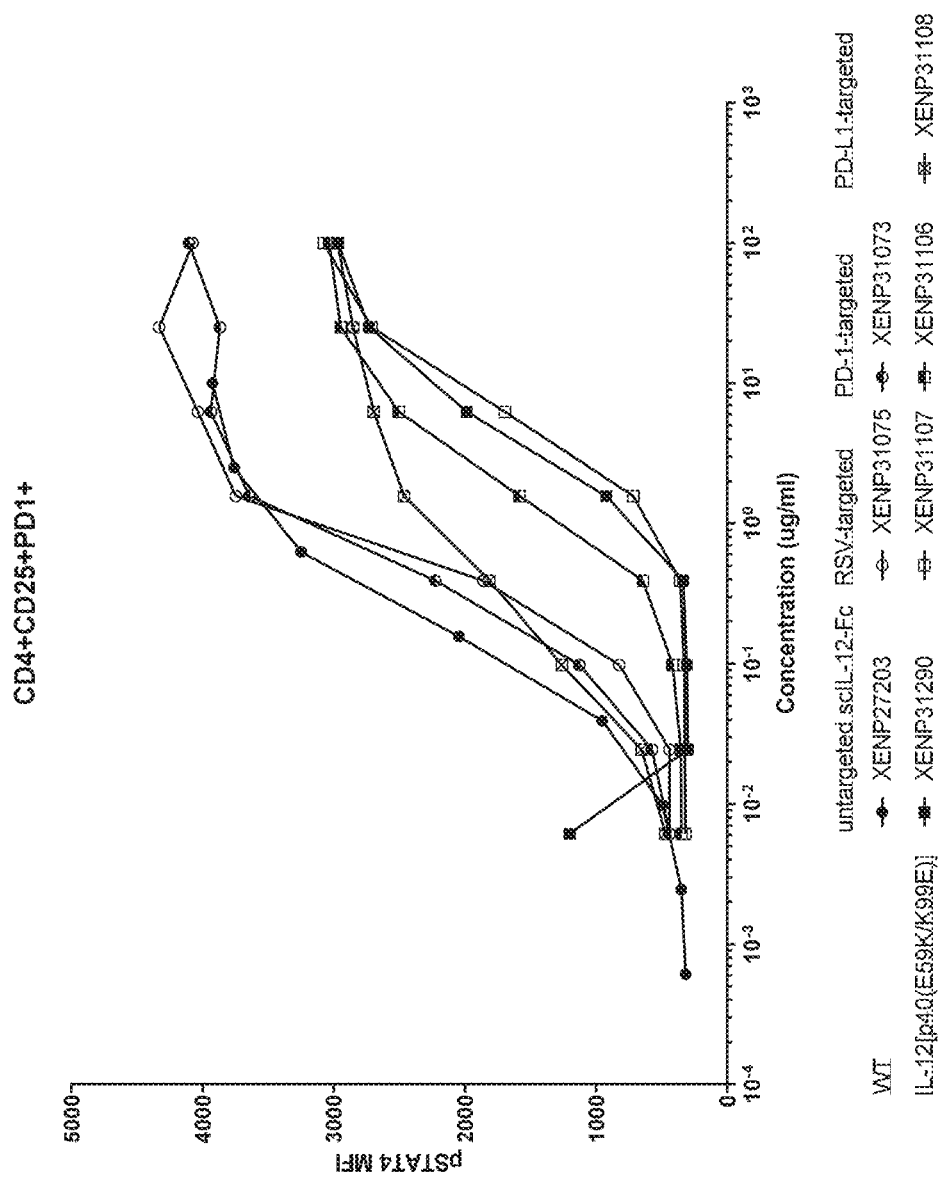

FIG. 83A and FIG. 83B depict STAT4 phosphorylation on A) CD4+CD25+PD1+ T cells and B) CD8+CD25+PD1+ T cells following incubation of activated PBMCs with untargeted and targeted IL-12-Fc fusions comprising WT or reduced potency IL-12[p40(E59K/K99E)] variant. RSV-targeted IL-12-Fc fusions demonstrate comparable activity to untargeted IL-12-Fc fusions. XENP31106 and XENP31108, respectively PD-1 and PD-L1-targeted IL-12-Fc fusions comprising reduced potency IL-12[p40(E59K/K99E)] variant, were both more potent than their untargeted and control RSV targeted counterparts. XENP31073, PD-1-targeted WT IL-12-Fc, demonstrated comparable activity to its untargeted and control-RSV-targeted counterparts.

Figure 84:
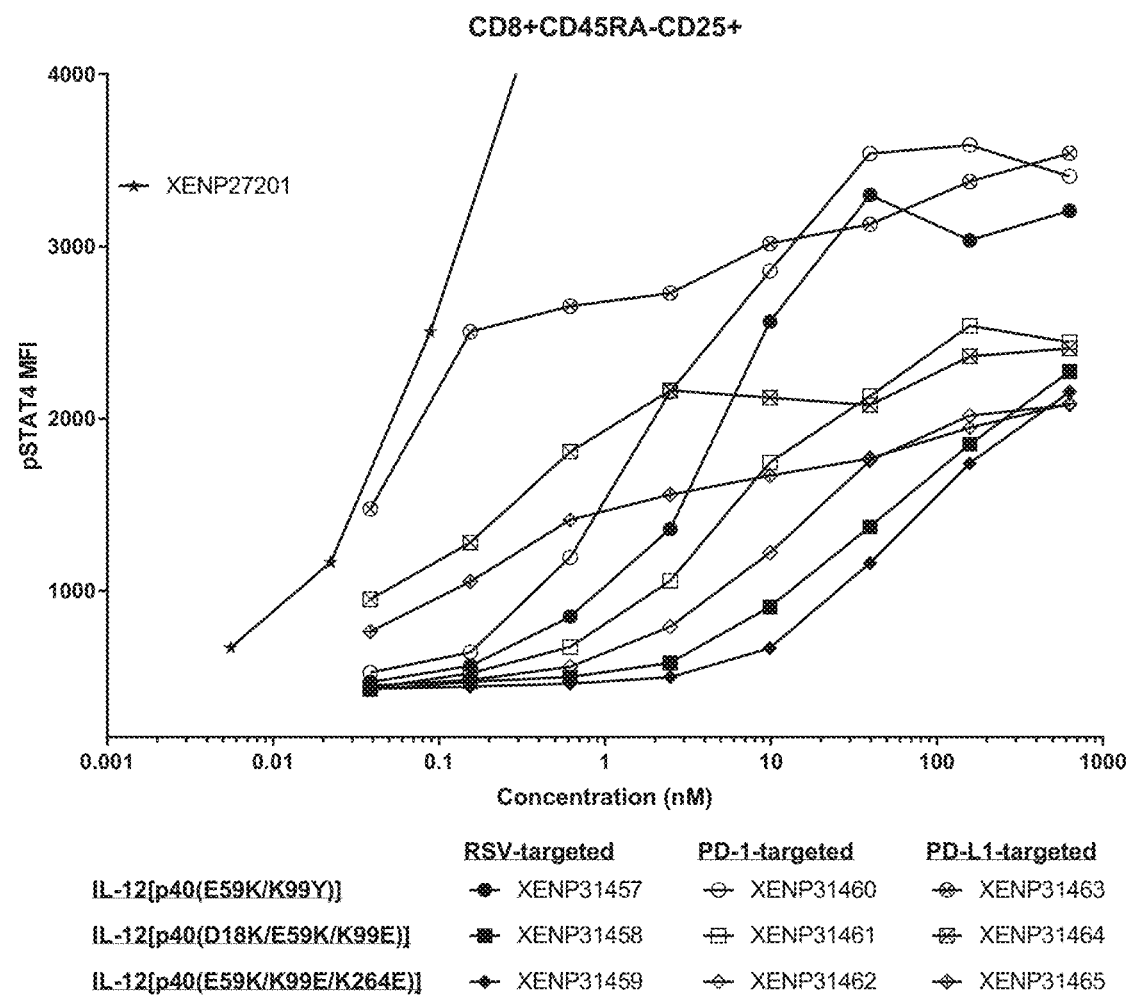

FIG. 84 depict STAT4 phosphorylation on CD8+ CD45RA−CD25+ T cells following incubation of activated PBMCs with targeted IL-12-Fc fusions comprising various reduced potency IL-12 variants. PD-1-targeted IL-12-Fc fusions were more potent than counterpart RSV-targeted IL-12-Fc fusions; and that PD-L1-targeted IL-12-Fc fusions were more potent than both counterpart RSV-targeted IL-12-Fc fusions and counterpart PD-1-targeted IL-12-Fc fusions.

Figure 85:
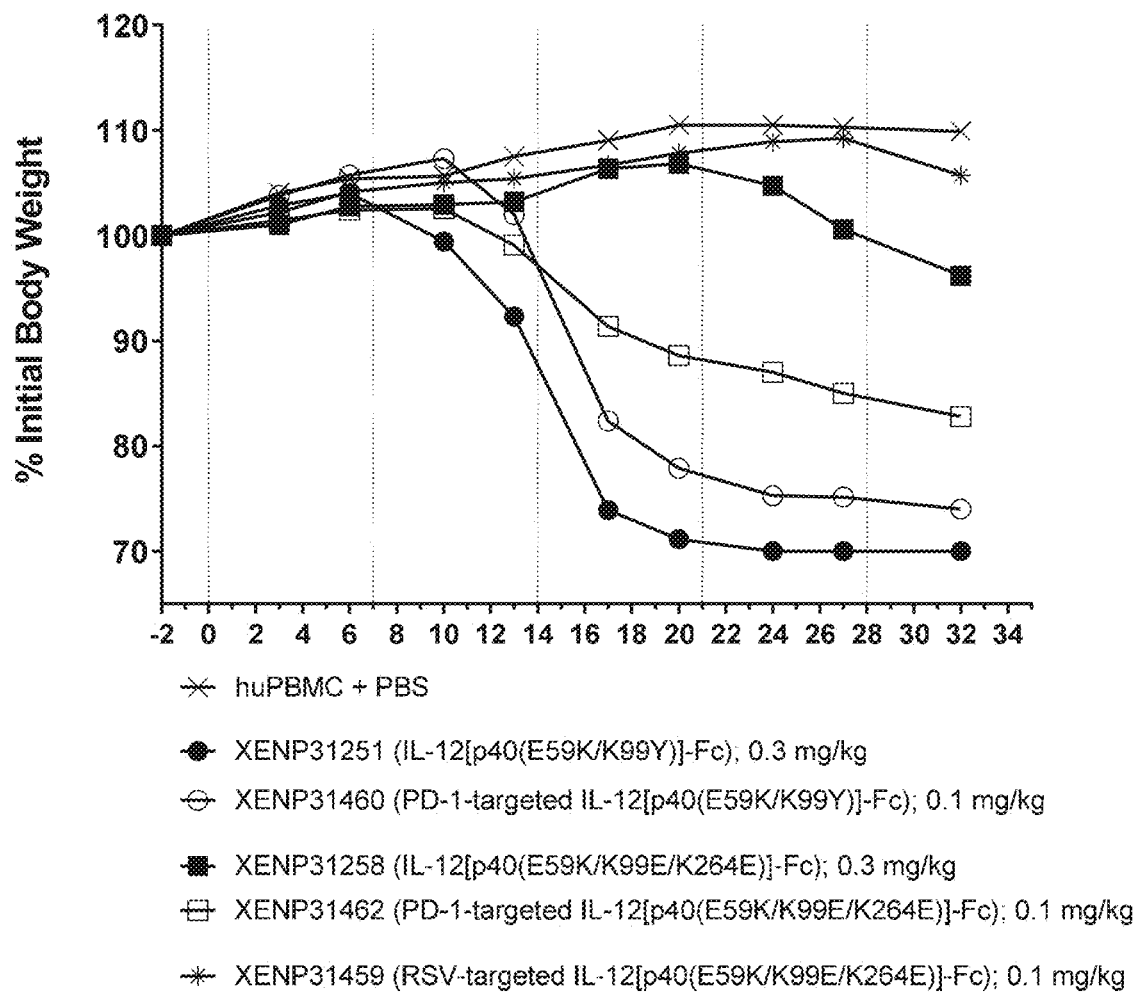
Figure 86A:
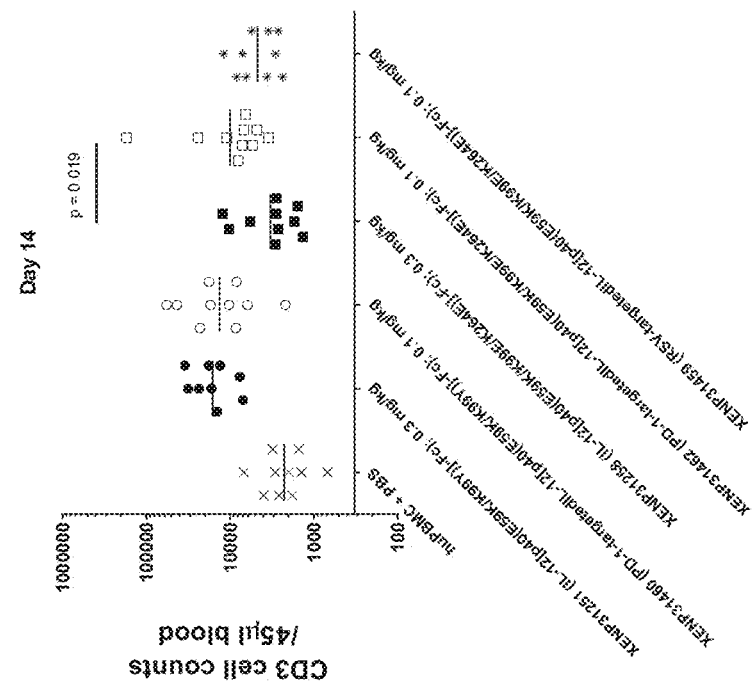
Figure 86B:
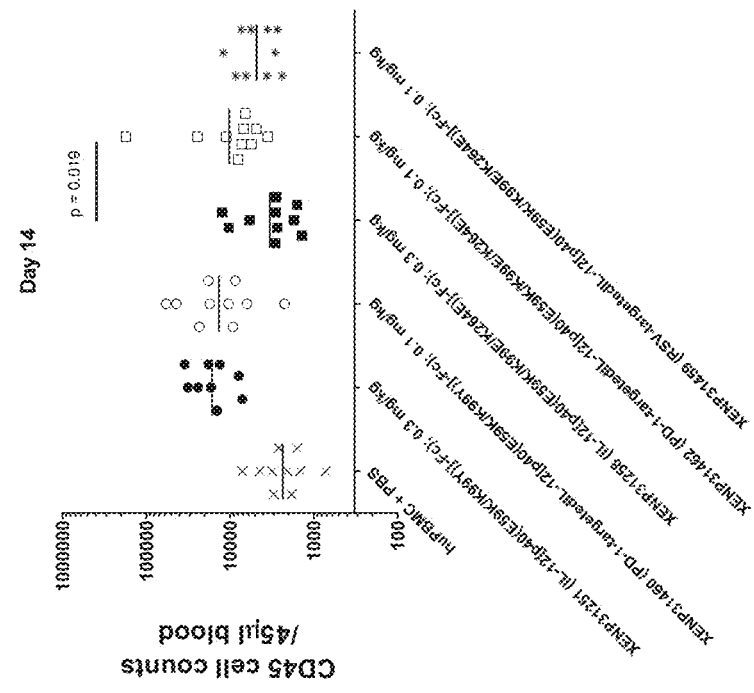
Figure 86D:
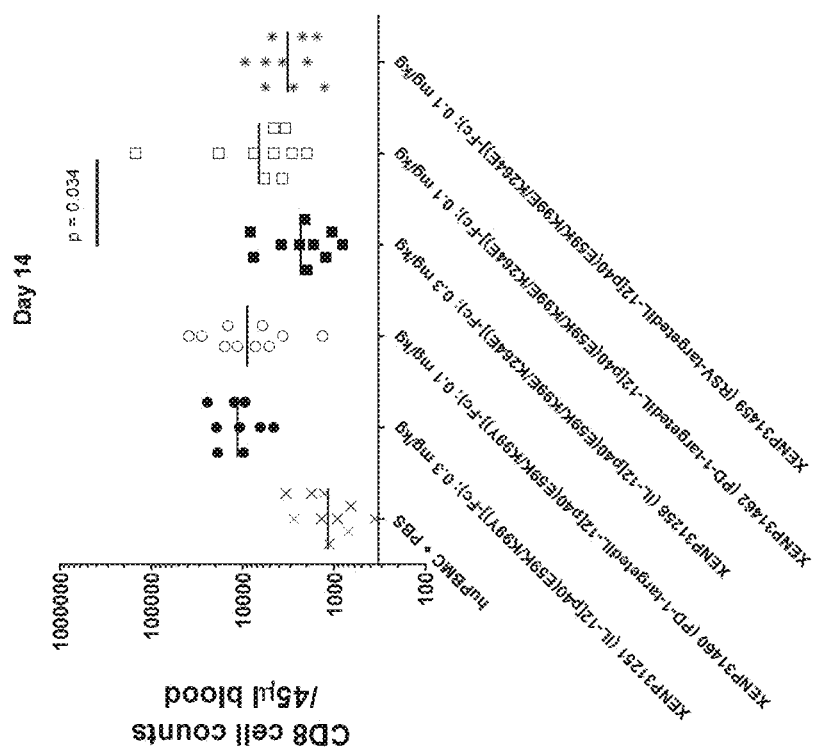
Figure 86C:
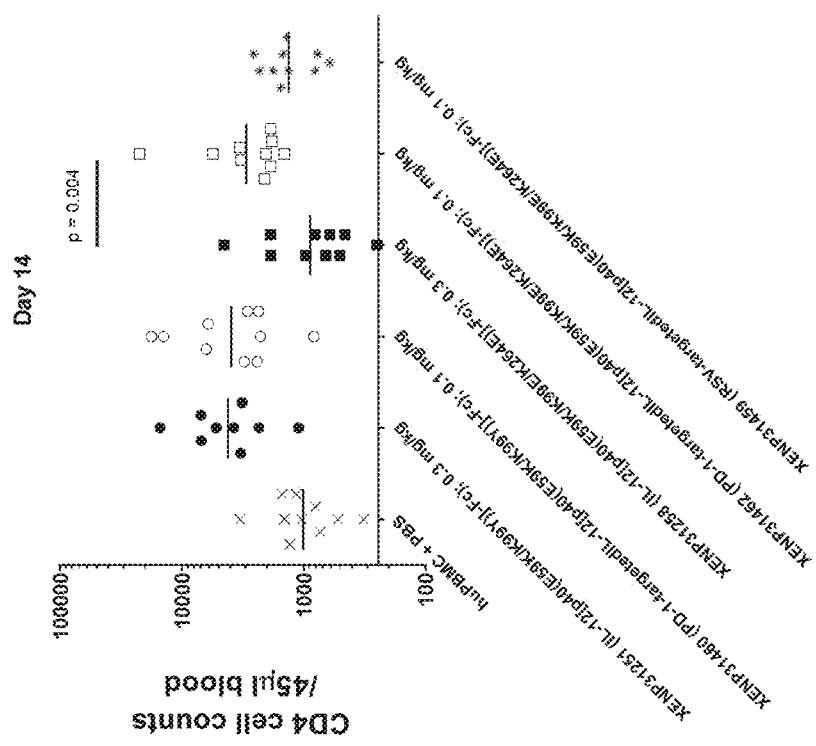
Figure 86E:
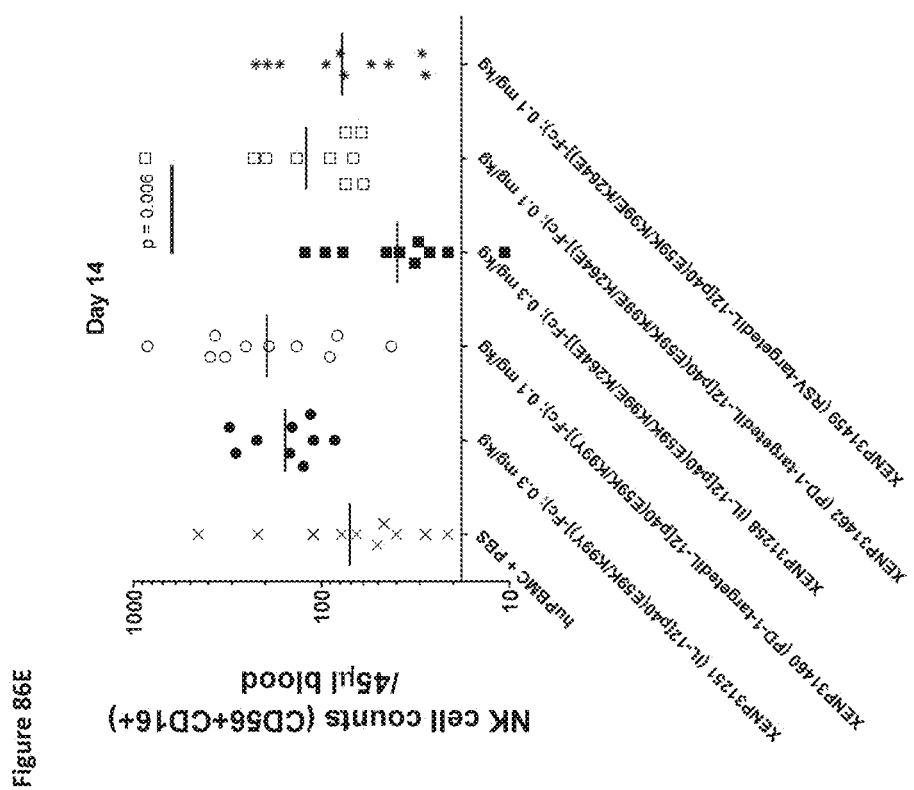

FIG. 85 depicts the change in body weight of huPBMC-engrafted NSG mice over time (as a percentage of initial body weight) after dosing with untargeted and PD-1-targeted IL-12-Fc fusions. XENP31462 significantly enhanced GVHD in comparison to XENP31258 by Day 17, despite XENP31462 having been administered at a lower dose.

FIG. 86A-FIG. 86E depict A) CD45+, B) CD3+, C) CD4+, D) CD8+, and E) NK cell counts on Day 14 after the first dose with the untargeted and PD-1-targeted IL-12-Fc fusions. XENP31462 significantly enhanced expansion of all lymphocyte populations by Day 14 (statistics performed on log-transformed data using unpaired t-test) despite XENP31462 having been administered at a lower dose than XENP31258.

Figure 87A:
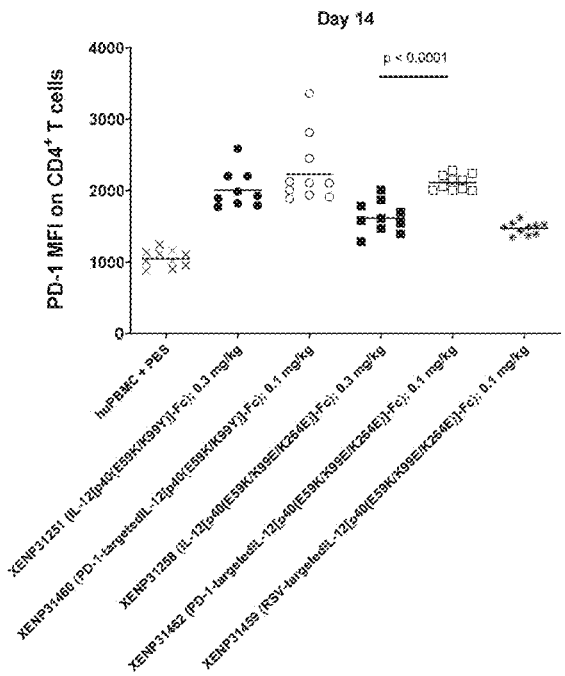
Figure 87B:
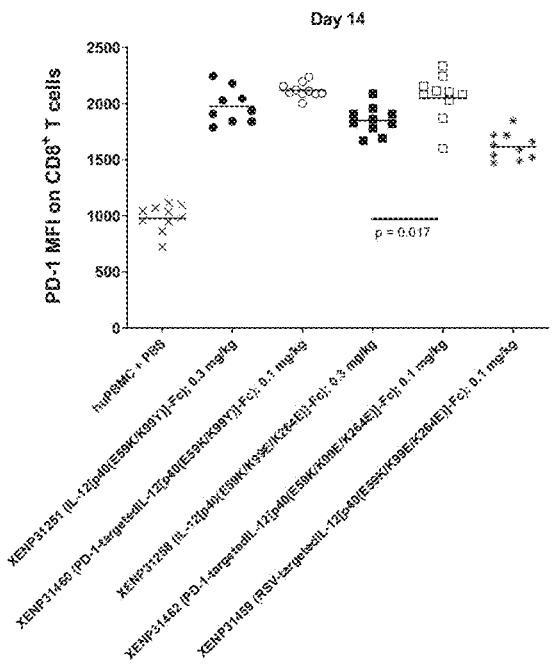

FIG. 87A and FIG. 87B depict activation of human A) CD4+ T cells and B) CD8+ T cells (as indicated by PD-1 MFI) in blood of huPBMC-engrafted NSG mice on Day 14 after first dose with the untargeted and PD-1-targeted IL-12-Fc fusions. XENP31462 significantly enhanced activation of T cells by Day 14 (statistics performed on log-transformed data using unpaired t-test) despite XENP31462 having been administered at a lower dose than XENP31258.

Figure 88:
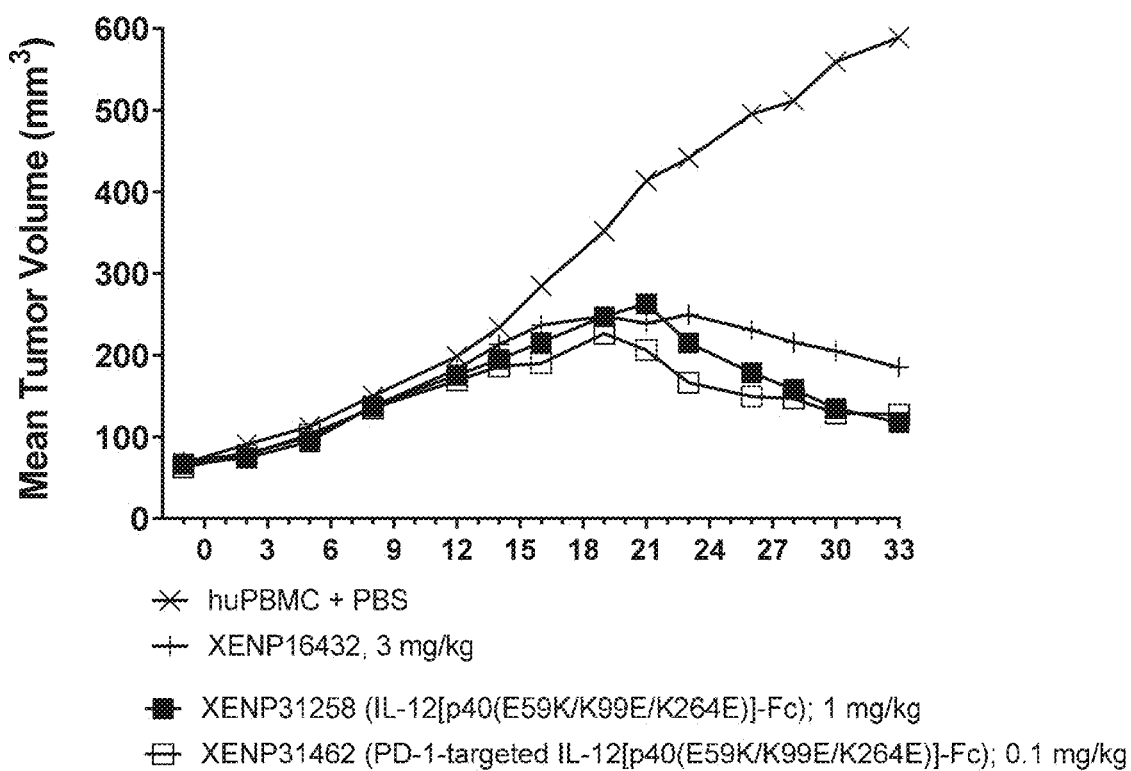

FIG. 88 depicts tumor volume (as determined by caliper measurements) over time in pp65-MCF7 and huPBMC-engrafted NSG mice dosed with XENP31258 (untargeted IL-12[p40(E59K/K99E/K264E)]-Fc fusion) or XENP31462 (PD-1-targeted IL-12[p40(E59K/K99E/K264E)]-Fc fusion). XENP31462 demonstrated equivalent anti-tumor activity to XENP31258 despite XENP31462 having been administered at a 10-fold lower dose.

FIGS. 89A-89C depict sequences of illustrative affinity/potency IL-12p40 subunit variants. FIG. 89A shows the amino acid sequence comprising an affinity variant substitution and a C252S substitution. FIG. 89B shows amino acid sequences comprising affinity variant substitutions and an N200Q substitution. FIG. 89C shows amino acid sequences comprising affinity variant substitutions and C252S and N200Q substitutions.

FIG. 90 depicts sequences for an illustrative variant IL-12-Fc non-Xtend fusion engineered with amino acid substitutions in the IL-12p40 subunit including a C252 substitution (in addition to expression and affinity/potency variants).

FIGS. 91A-91C depict sequences for illustrative variant IL-12-Fc non-Xtend fusions engineered with amino acid substitutions in the IL-12p40 subunit including an N200Q substitution (in addition to expression and affinity/potency variants), for instance, XENP33669, XENP33671, and XENP33672.

FIGS. 92A-92C depict sequences for illustrative variant IL-12-Fc non-Xtend fusions engineered with amino acid substitutions in the IL-12p40 subunit including C252S and N200Q substitutions (in addition to expression and affinity/potency variants), for instance, XENP33670 and XENP33673.

FIG. 93 depicts sequences for an illustrative variant IL-12-Fc non-Xtend fusion protein XENP33468.

FIG. 94 depicts sequences for illustrative variant IL-12-Fc Xtend proteins including XENP33680.

FIGS. 95A-95C depict sequences for illustrative variant IL-12-Fc Xtend fusions engineered with amino acid substitutions in the IL-12p40 subunit including a C252 substitution (in addition to expression and affinity/potency variants), for instance, XENP33674, XENP33677, and XENP33681.

FIGS. 96A-96C depict sequences for illustrative variant IL-12-Fc Xtend fusions engineered with amino acid substitutions in the IL-12p40 subunit including an N200Q substitution (in addition to expression and affinity/potency variants), for instance, XENP33675, XENP33678, and XENP33682.

FIGS. 97A-97C depict sequences for illustrative variant IL-12-Fc Xtend fusions engineered with amino acid substitutions in the IL-12p40 subunit including C252S and N200Q substitutions (in addition to expression and affinity/potency variants), for instance, XENP33676, XENP33679, and XENP33683.

FIGS. 98A-98B depict sequences for illustrative PD-1 targeted variant IL-12-Fc Non-Xtend fusions engineered with amino acid substitutions in the IL-12p40 subunit (e.g., affinity/potency variants).

FIGS. 99A-99B depict sequences for illustrative PD-1 targeted variant IL-12-Fc non-Xtend fusions engineered with amino acid substitutions in the IL-12p40 subunit including a C252 substitution.

FIGS. 100A-100D depict sequences for illustrative PD-1 targeted variant IL-12-Fc non-Xtend fusions engineered with amino acid substitutions in the IL-12p40 subunit including an N200Q substitution, for instance, XENP33686.

FIGS. 101A-101D depict sequences for illustrative PD-1 targeted variant IL-12-Fc non-Xtend fusions engineered with amino acid substitutions in the IL-12p40 subunit including C252S and N200Q substitutions, for instance, XENP33687.

FIGS. 102A-102D depict sequences for illustrative PD-1 targeted variant IL-12-Fc Xtend fusions engineered with amino acid substitutions in the IL-12p40 subunit, for instance, XENP33693.

FIGS. 103A-103D depict sequences for illustrative PD-1 targeted variant IL-12-Fc Xtend fusions engineered with amino acid substitutions in the IL-12p40 subunit including a C252S substitution, for instance, XENP33695.

FIGS. 104A-104D depict sequences for illustrative PD-1 targeted variant IL-12-Fc Xtend fusions engineered with amino acid substitutions in the IL-12p40 subunit including an N200Q substitution, for instance, XENP33696.

FIGS. 105A-105D depict sequences for illustrative PD-1 targeted variant IL-12-Fc Xtend fusions engineered with amino acid substitutions in the IL-12p40 subunit including C252S and N200Q substitutions, for instance, XENP33697.

FIG. 106 depicts sequences for an illustrative RSV targeted variant IL-12-Fc non-Xtend fusion engineered with amino acid substitutions in the IL-12p40 subunit (e.g., affinity/potency variants).

FIGS. 107A-107B depict sequences for illustrative RSV targeted variant IL-12-Fc non-Xtend fusions engineered with amino acid substitutions in the IL-12p40 subunit including a C252 substitution.

FIGS. 108A-108D depict sequences for illustrative RSV targeted variant IL-12-Fc non-Xtend fusions engineered with amino acid substitutions in the IL-12p40 subunit including an N200Q substitution, for instance, XENP33684.

FIGS. 109A-109D depict sequences for illustrative RSV targeted variant IL-12-Fc non-Xtend fusions engineered with amino acid substitutions in the IL-12p40 subunit including C252S and N200Q substitutions, for instance, XENP33685.

FIGS. 110A-110D depict sequences for illustrative RSV targeted variant IL-12-Fc Xtend fusions engineered with amino acid substitutions in the IL-12p40 subunit (e.g., affinity/potency variants), for instance, XENP33689.

FIGS. 111A-111D depict sequences for illustrative RSV targeted variant IL-12-Fc Xtend fusions engineered with amino acid substitutions in the IL-12p40 subunit including a C252 substitution, for instance, XENP33690.

FIGS. 112A-112D depict sequences for illustrative RSV targeted variant IL-12-Fc Xtend fusions engineered with amino acid substitutions in the IL-12p40 subunit including an N200Q substitution, for instance, XENP33691.

FIGS. 113A-113D depict sequences for illustrative RSV targeted variant IL-12-Fc Xtend fusions engineered with amino acid substitutions in the IL-12p40 subunit including C252S and N200Q substitutions, for instance, XENP33692.

FIGS. 114A-114B depicts sequences for illustrative PD-L1 targeted variant IL-12-Fc non-Xtend fusions engineered with amino acid substitutions in the IL-12p40 subunit (e.g., affinity/potency variants).

FIGS. 115A-115D depict sequences for illustrative PD-L1 targeted variant IL-12-Fc non-Xtend fusions engineered with amino acid substitutions in the IL-12p40 subunit including a C252 substitution.

FIGS. 116A-116D depict sequences for illustrative PD-L1 targeted variant IL-12-Fc non-Xtend fusions engineered with amino acid substitutions in the IL-12p40 subunit including an N200Q substitution.

FIGS. 117A-117D depict sequences for illustrative PD-L1 targeted variant IL-12-Fc non-Xtend fusions engineered with amino acid substitutions in the IL-12p40 subunit including C252S and N200Q substitutions.

FIGS. 118A-118D depicts sequences for illustrative PD-L1 targeted variant IL-12-Fc Xtend fusions engineered with amino acid substitutions in the IL-12p40 subunit (e.g., affinity/potency variants).

FIGS. 119A-119D depict sequences for illustrative PD-L1 targeted variant IL-12-Fc Xtend fusions engineered with amino acid substitutions in the IL-12p40 subunit including a C252 substitution.

FIGS. 120A-120D depict sequences for illustrative PD-L1 targeted variant IL-12-Fc Xtend fusions engineered with amino acid substitutions in the IL-12p40 subunit including an N200Q substitution.

FIGS. 121A-121D depict sequences for illustrative PD-L1 targeted variant IL-12-Fc Xtend fusions engineered with amino acid substitutions in the IL-12p40 subunit including C252S and N200Q substitutions.

Figure 122A:
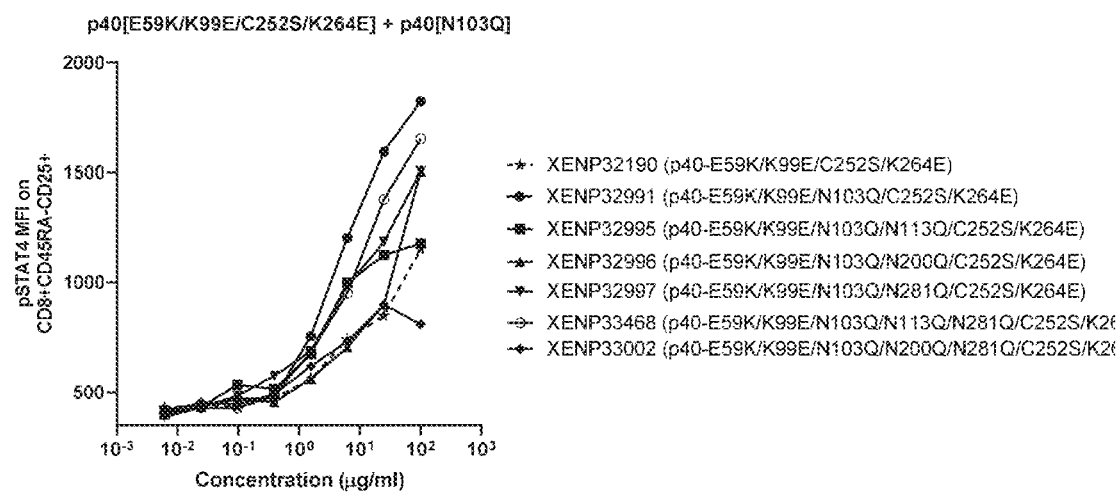

FIGS. 122A-1222D depict STAT4 phosphorylation on CD8+CD45RA−CD25+ T cells following incubation of activated PBMCs with XENP32190 (IL-12-Fc fusions comprising IL-12p40 variant E59K/K99E/C252S/K264E) in comparison to (FIG. 122A) IL-12-Fc fusions further comprising at least p40[N103Q] deglycosylation variant, (FIG. 122B) IL-12-Fc fusions further comprising at least p40[N113Q] deglycosylation variant, (FIG. 122C) IL-12-Fc fusions further comprising at least p40[N200Q] deglycosylation variant, and (FIG. 122D) IL-12-Fc fusions further comprising at least p40[N281Q] deglycosylation variant. The data generally show that N103Q variant enhances potency, N200Q variant decreases potency, and the N113Q and N281Q variants do not affect potency of the IL-12-Fc fusions.

Figure 123:
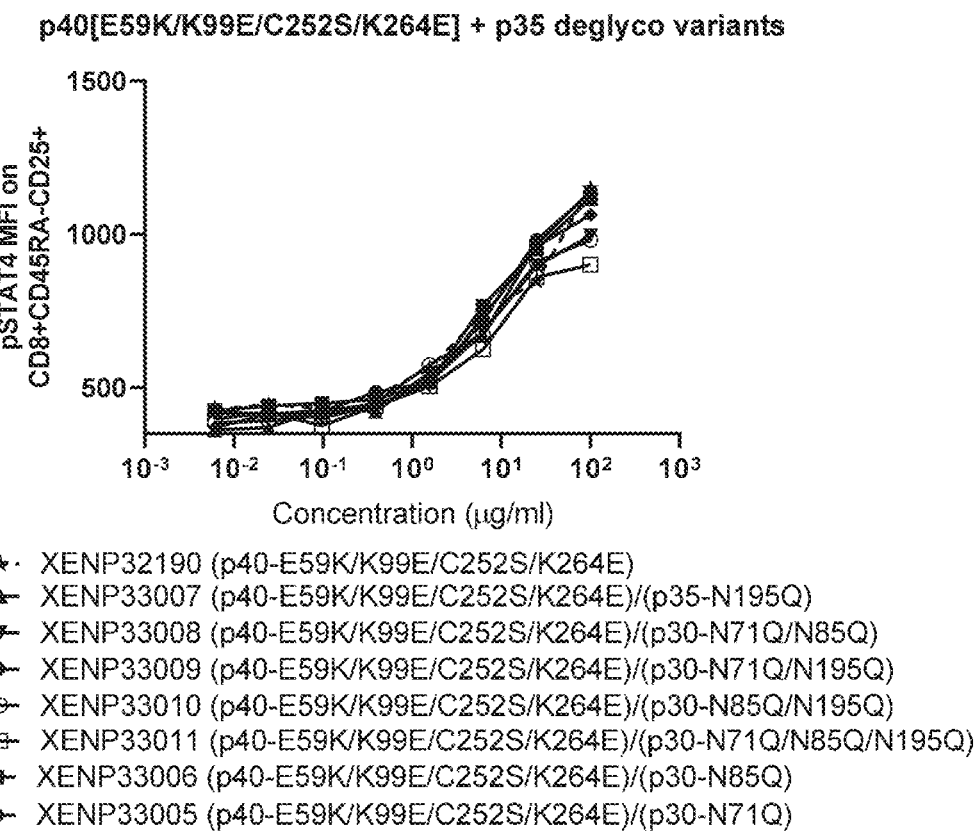

FIG. 123 depicts STAT4 phosphorylation on CD8+ CD45RA−CD25+ T cells following incubation of activated PBMCs with XENP32190 (IL-12-Fc fusions comprising IL-12p40 variant E59K/K99E/C252S/K264E) in comparison to IL-12-Fc fusions further comprising p35 deglycosylation variants. The data show that none of the p35 deglycosylation variants affect the potency of IL-12-Fc fusions.

For sequences provided in the figures, in some instances, linkers are double underlined (although as will be appreciated by those in the art, the linkers can be replaced by other linkers, some of which are depicted in FIG. 6), and slashes (/) indicate the border(s) between IL-12p35, IL-12p40, linkers, and Fc regions.

DETAILED DESCRIPTION OF THE INVENTION

I. Overview

The present invention is directed to novel heterodimeric fusion protein constructs containing antigen binding domains, IL-12 subunits and Fc domains.

As noted above, IL-12 is composed of an α-chain (the p35 subunit; IL-12p35) and a β-chain (the p40 subunit; IL-12p40) covalently linked to form the biologically active IL-12 heterodimer. IL-12 exerts its cell signaling function through binding by binding to a dimeric IL-12 receptor complex composed of IL-12 receptor β1 (IL-12Rβ1) and IL-12 receptor β2 (IL-12Rβ2) on T cells and inducing IFNγ secretion. However, the IL-12p40 subunit can also exist as a homodimer which has been reported to antagonize IL-12 activity by competing for binding to IL-12 receptor. Accordingly, the present invention addresses the short half-life of IL-12 by providing IL-12-Fc fusion proteins, as well as novel IL-12 variants with decreased potency. As generally shown in FIGS. 79A-79E, the targeted IL-12 heterodimeric fusion proteins of the invention can take on a variety of conformations.

The PD-1 targeted IL-12 heterodimeric Fc proteins of the present invention can promote or induce T cell activation. In some embodiments, administration of any one of the PD-1 targeted IL-12 heterodimeric Fc proteins to a patient induces T cell activation in the patient. In some instances, administration induces IFN-gamma secretion in the patient. In some cases, administration of the PD-1 targeted IL-12 heterodimeric Fc proteins induces expansion of lymphocytes in the patient.

Such PD-1 targeted IL-12 heterodimeric Fc proteins are useful for treating cancer such as solid tumor cancers or liquid tumor cancers. In some embodiments, administration of any one of the PD-1 targeted IL-12 heterodimeric Fc proteins to a patient reduces tumor size. In some embodiments, PD-1 targeted IL-12 heterodimeric Fc proteins of the present invention have increased therapeutic activity compared to a comparable untargeted IL-12 heterodimeric Fc protein.

Exemplary non-limiting variant IL-12p35 proteins, variant IL-12p40 proteins, untargeted IL-12 Fc fusion proteins, and formats of such are disclosed in U.S. Provisional Application No. 62/740,813 filed Oct. 3, 2018, U.S. Provisional Application No. 62/848,512 filed May 15, 2019, PCT Application No. PCT/US19/54570 filed Oct. 3, 2019, and U.S. application Ser. No. 16/592,656 filed Oct. 3, 2019, U.S. Provisional Application No. 63/005,083 filed Apr. 3, 2020, the disclosures of which are incorporated herein by reference in their entirety, including the Figures, Figure descriptions, claims, and sequence listings.

Exemplary non-limiting PD-1 antibodies useful in the present invention are disclosed in PCT Application No. PCT/US19/28206 filed Apr. 18, 2019, U.S. application Ser. No. 16/388,811 filed Apr. 18, 2019, U.S. Provisional Application No. 62/784,334 filed Dec. 21, 2018, US2019/0270816 filed Nov. 8, 2018, WO2019/094637 filed Nov. 8, 2018, US2019/0263909 filed Nov. 8, 2018, and U.S. Provisional Application No. 62/744,946 filed Oct. 12, 2018, the disclosures are incorporated herein by reference in their entirety, including the Figures, Figure descriptions, and sequence listings.

II. Definitions

In order that the application may be more completely understood, several definitions are set forth below. Such definitions are meant to encompass grammatical equivalents.

By "ablation" herein is meant a decrease or removal of binding and/or activity. Thus for example, "ablating FcγR binding" means the Fc region amino acid variant has less than 50% starting binding as compared to an Fc region not containing the specific variant, with less than 70-80-90-95-98% loss of binding being preferred, and in general, with the binding being below the level of detectable binding in a Biacore assay. Of particular use in the ablation of FcγR binding are those shown in FIG. 4. However, unless otherwise noted, the Fc monomers of the invention retain binding to the FcRn.

By "ADCC" or "antibody dependent cell-mediated cytotoxicity" as used herein is meant the cell-mediated reaction wherein nonspecific cytotoxic cells that express FcγRs recognize bound antibody on a target cell and subsequently cause lysis of the target cell. ADCC is correlated with binding to FcγRIIIa; increased binding to FcγRIIIa leads to an increase in ADCC activity. As is discussed herein, many embodiments of the invention ablate ADCC activity entirely.

By "modification" herein is meant an amino acid substitution, insertion, and/or deletion in a polypeptide sequence or an alteration to a moiety chemically linked to a protein. For example, a modification may be an altered carbohydrate or PEG structure attached to a protein. By "amino acid modification" herein is meant an amino acid substitution, insertion, and/or deletion in a polypeptide sequence. For clarity, unless otherwise noted, the amino acid modification is always to an amino acid coded for by DNA, e.g., the 20 amino acids that have codons in DNA and RNA.

By "amino acid substitution" or "substitution" herein is meant the replacement of an amino acid at a particular position in a parent polypeptide sequence with a different amino acid. In particular, in some embodiments, the substitution is to an amino acid that is not naturally occurring at the particular position, either not naturally occurring within the organism or in any organism. For example, the substitution E272Y or 272Y refers to a variant polypeptide, in this case an Fc variant, in which the glutamic acid at position 272 is replaced with tyrosine. For clarity, a protein which has been engineered to change the nucleic acid coding sequence but not to change the starting amino acid (for example exchanging CGG (encoding arginine) to CGA (still encoding arginine) to increase host organism expression levels) is not an "amino acid substitution"; that is, despite the creation of a new gene encoding the same protein, if the protein has the same amino acid at the particular position that it started with, it is not an amino acid substitution.

By "amino acid insertion" or "insertion" as used herein is meant the addition of an amino acid residue or sequence at a particular position in a parent polypeptide sequence. For example, −233E designates an insertion of glutamic acid after position 233 and before position 234. Additionally,−233ADE or A233ADE designates an insertion of AlaAspGlu after position 233 and before position 234.

By "amino acid deletion" or "deletion" as used herein is meant the removal of an amino acid residue or sequence at a particular position in a parent polypeptide sequence. For example, E233-, E233 #, E233( ) or E233del designates a deletion of glutamic acid at position 233. Additionally, EDA233- or EDA233 #designates a deletion of the sequence GluAspAla that begins at position 233.

By "variant protein", "protein variant", or "variant" as used herein is meant a protein that differs from that of a parent protein by virtue of at least one modification. Protein variant may refer to the protein itself, a composition comprising the protein, the amino acid sequence that encodes it, or the DNA sequence that encodes it. Preferably, the protein variant has at least one amino acid modification compared to the parent protein, e.g. from about one to about seventy amino acid modifications, and preferably from about one to about five amino acid modifications compared to the parent. The modification can be an addition, deletion, or substitution. As described below, in some embodiments the parent polypeptide, for example an Fc parent polypeptide, is a human wild type sequence, such as the Fc region from IgG1, IgG2, IgG3 or IgG4. The protein variant sequence herein will preferably possess at least about 80% identity with a parent protein sequence, and most preferably at least about 90% identity, more preferably at least about 95-98-99% identity.

As used herein, by "protein" is meant at least two covalently attached amino acids, which includes proteins, polypeptides, oligopeptides and peptides. When a biologically functional molecule or complex comprises two or more proteins, each protein may be referred to as a "monomer" or as a "subunit" or as a "domain"; and the biologically functional molecule may be referred to as a "complex". In some embodiments, the two or more proteins of a functional complex are non-covalently attached. In some embodiments, the term "monomer" refers to a polypeptide or protein comprising one or more components, fragments, or subunits of a protein(s), and the components, fragments, or subunits are covalently attached.

By "residue" as used herein is meant a position in a protein and its associated amino acid identity. For example, Asparagine 297 (also referred to as Asn297 or N297) is a residue at position 297 in the human antibody IgG1.

By "IgG subclass modification" or "isotype modification" as used herein is meant an amino acid modification that converts one amino acid of one IgG isotype to the corresponding amino acid in a different, aligned IgG isotype. For example, because IgG1 comprises a tyrosine and IgG2 a phenylalanine at EU position 296, a F296Y substitution in IgG2 is considered an IgG subclass modification.

The carboxy-terminal portion of each IgG chain defines a constant region primarily responsible for effector function. Kabat et al. collected numerous primary sequences of the variable regions of heavy chains and light chains. Based on the degree of conservation of the sequences, they classified individual primary sequences into the CDRs and the framework and made a list thereof (see SEQUENCES OF IMMUNOLOGICAL INTEREST, 5th edition, NIH publication, No. 91-3242, E. A. Kabat et al., entirely incorporated by reference). Throughout the present specification, the Kabat numbering system is generally used when referring to a residue in the variable domain (approximately, residues 1-107 of the light chain variable region and residues 1-113 of the heavy chain variable region) and the EU numbering system for Fc regions (e.g., Kabat et al., supra (1991)).

In the IgG subclass of immunoglobulins, there are several immunoglobulin domains in the heavy chain. By "immunoglobulin (Ig) domain" herein is meant a region of an immunoglobulin having a distinct tertiary structure. Of interest in the present invention are the heavy chain domains, including, the constant heavy (CH) domains and the hinge domains. In the context of IgG antibodies, the IgG isotypes each have three CH regions. Accordingly, "CH" domains in the context of IgG are as follows: "CH1" refers to positions 118-215 according to the EU index as in Kabat. "Hinge" refers to positions 216-230 according to the EU index as in Kabat. "CH2" refers to positions 231-340 according to the EU index as in Kabat, and "CH3" refers to positions 341-447 according to the EU index as in Kabat. As shown in Table 1, the exact numbering and placement of the heavy chain domains can be different among different numbering systems. As shown herein and described below, the pI variants can be in one or more of the CH regions, as well as the hinge region, discussed below.

Another type of Ig domain of the heavy chain is the hinge region. By "hinge" or "hinge region" or "antibody hinge region" or "immunoglobulin hinge region" herein is meant the flexible polypeptide comprising the amino acids between the first and second heavy chain constant domains of an antibody. Structurally, the IgG CH1 domain ends at EU position 215, and the IgG CH2 domain begins at residue EU position 231. Thus for IgG the antibody hinge is herein defined to include positions 216 (E216 in IgG1) to 230 (P230 in IgG1), wherein the numbering is according to the EU index as in Kabat. In some embodiments, for example in the context of an Fc region, the hinge is included, generally referring to positions 216-230. As noted herein, pI variants can be made in the hinge region as well.

By "non-naturally occurring modification" as used herein is meant an amino acid modification that is not isotypic. For example, because none of the IgGs comprise a serine at position 434, the substitution 434S in IgG1, IgG2, IgG3, or IgG4 (or hybrids thereof) is considered a non-naturally occurring modification.

By "amino acid" and "amino acid identity" as used herein is meant one of the 20 naturally occurring amino acids that are coded for by DNA and RNA.

By "effector function" as used herein is meant a biochemical event that results from the interaction of an antibody Fc region with an Fc receptor or ligand. Effector functions include but are not limited to ADCC, ADCP, and CDC.

By "IgG Fc ligand" or "Fc ligand" as used herein is meant a molecule, preferably a polypeptide, from any organism that binds to the Fc region of an IgG antibody to form an Fc/Fc ligand complex. Fc ligands include but are not limited to FcγRIs, FcγRIIs, FcγRIIIs, FcRn, C1q, C3, mannan binding lectin, mannose receptor, staphylococcal protein A, streptococcal protein G, and viral FcγR. Fc ligands also include Fc receptor homologs (FcRH), which are a family of Fc receptors that are homologous to the FcγRs (Davis et at, 2002, Immunological Reviews 190:123-136, entirely incorporated by reference). Fc ligands may include undiscovered molecules that bind Fc. Particular IgG Fc ligands are FcRn and Fc gamma receptors.

By "Fc gamma receptor", "FcγR" or "FcgammaR" as used herein is meant any member of the family of proteins that bind the IgG antibody Fc region and is encoded by an FcγR gene. In humans this family includes but is not limited to FcγRI (CD64), including isoforms FcγRIa, FcγRIb, and FcγRIc; FcγRII (CD32), including isoforms FcγRIIa (including allotypes H131 and R131), FcγRIIb (including FcγRIIb-1 and FcγRIIb-2), and FcγRIIc; and FcγRIII (CD16), including isoforms FcγRIIIa (including allotypes V158 and F158) and FcγRIIIb (including allotypes FcγRIIb-NA1 and FcγRIIb-NA2) (Jefferis et al., 2002, Immunol Lett 82:57-65, entirely incorporated by reference), as well as any undiscovered human FcγRs or FcγR isoforms or allotypes. An FcγR may be from any organism, including but not limited to humans, mice, rats, rabbits, and monkeys. Mouse FcγRs include but are not limited to FcγRI (CD64), FcγRII (CD32), FcγRIII (CD16), and FcγRIII-2 (CD16-2), as well as any undiscovered mouse FcγRs or FcγR isoforms or allotypes.

By "FcRn" or "neonatal Fc receptor" as used herein is meant a protein that binds the IgG antibody Fc region and is encoded at least in part by an FcRn gene. The FcRn may be from any organism, including but not limited to humans, mice, rats, rabbits, and monkeys. As is known in the art, the functional FcRn protein comprises two polypeptides, often referred to as the heavy chain and light chain. The light chain is beta-2-microglobulin (β2-microglobulin) and the heavy chain is encoded by the FcRn gene. Unless otherwise noted herein, FcRn or an FcRn protein refers to the complex of FcRn heavy chain with β2-microglobulin. A variety of Fc variants can be used to increase binding to the FcRn, and in some cases, to increase serum half-life. In general, unless otherwise noted, the Fc monomers of the invention retain binding to the FcRn (and, as noted below, can include amino acid variants to increase binding to the FcRn).

By "parent polypeptide" as used herein is meant a starting polypeptide that is subsequently modified to generate a variant. The parent polypeptide may be a naturally occurring polypeptide, or a variant or engineered version of a naturally occurring polypeptide. Parent polypeptide may refer to the polypeptide itself, compositions that comprise the parent polypeptide, or the amino acid sequence that encodes it.

By "Fc" or "Fc region" or "Fc domain" as used herein is meant the polypeptide comprising the constant region of an antibody, in some instances, excluding all of the first constant region immunoglobulin domain (e.g., CH1) or a portion thereof, and in some cases, optionally including all or part of the hinge. For IgG, the Fc domain comprises immunoglobulin domains CH2 and CH3 (Cγ2 and Cγ3), and optionally all or a portion of the hinge region between CH1 (Cγ1) and CH2 (Cγ2). Thus, in some cases, the Fc domain includes, from N- to C-terminal, CH2-CH3 and hinge-CH2-CH3. In some embodiments, the Fc domain is that from IgG1, IgG2, IgG3 or IgG4, with IgG1 hinge-CH2-CH3 and IgG4 hinge-CH2-CH3 finding particular use in many embodiments. Additionally, in the case of human IgG1 Fc domains, frequently the hinge includes a C220S amino acid substitution. Furthermore, in the case of human IgG4 Fc domains, frequently the hinge includes a S228P amino acid substitution. Although the boundaries of the Fc region may vary, the human IgG heavy chain Fc region is usually defined to include residues E216, C226, or A231 to its carboxyl-terminus, wherein the numbering is according to the EU index as in Kabat. In some embodiments, as is more fully described below, amino acid modifications are made to the Fc region, for example to alter binding to one or more FcγR or to the FcRn.

As will be appreciated by those in the art, the exact numbering and placement of the heavy constant region domains can be different among different numbering systems. A useful comparison of heavy constant region numbering according to EU and Kabat is as below, see Edelman et al., 1969, Proc Natl Acad Sci USA 63:78-85 and Kabat et al., 1991, Sequences of Proteins of Immunological Interest, 5th Ed., United States Public Health Service, National Institutes of Health, Bethesda, entirely incorporated by reference.

TABLE 1

|  | EU Numbering | Kabat Numbering |
|---|---|---|
| CH1 | 118-215 | 114-223 |
| Hinge | 216-230 | 226-243 |
| CH2 | 231-340 | 244-360 |
| CH3 | 341-447 | 361-478 |

"Fc variant" or "variant Fc" as used herein is meant a protein comprising an amino acid modification in an Fc domain. The modification can be an addition, deletion, or substitution. The Fc variants of the present invention are defined according to the amino acid modifications that compose them. Thus, for example, N434S or 434S is an Fc variant with the substitution for serine at position 434 relative to the parent Fc polypeptide, wherein the numbering is according to the EU index. Likewise, M428L/N434S defines an Fc variant with the substitutions M428L and N434S relative to the parent Fc polypeptide. The identity of the WT amino acid may be unspecified, in which case the aforementioned variant is referred to as 428L/434S. It is noted that the order in which substitutions are provided is arbitrary, that is to say that, for example, 428L/434S is the same Fc variant as 434S/428L, and so on. For all positions discussed in the present invention that relate to antibodies or derivatives and fragments thereof, unless otherwise noted, amino acid position numbering is according to the EU index. The EU index or EU index as in Kabat or EU numbering scheme refers to the numbering of the EU antibody (Edelman et al., 1969, Proc Natl Acad Sci USA 63:78-85, hereby entirely incorporated by reference). The modification can be an addition, deletion, or substitution.

By "fusion protein" as used herein is meant covalent joining of at least two proteins or protein domains. Fusion proteins may comprise artificial sequences, e.g. a domain linker, variant Fc domains, a variant IL-12p40 subunit domain, a variant IL-12p35 subunit domain, etc. as described herein. By "Fc fusion protein" or "immunoadhesin" herein is meant a protein comprising an Fc region, generally linked (optionally through a domain linker, as described herein) to one or more different protein domains. Accordingly, an "IL-12 Fc fusion" comprises an Fc region linked (optionally but usually through a domain linker) to an IL-12p40 subunit, an IL12p35 subunit and/or single-chain IL-12 complex (scIL-12), as described herein. In some instances, two Fc fusion proteins can form a homodimeric Fc fusion protein or a heterodimeric Fc fusion protein with the latter being preferred in some instances. In some cases, one monomer of the heterodimeric Fc fusion protein comprises an Fc domain alone (e.g., an "empty Fc domain") and the other monomer is an Fc fusion, comprising a variant Fc domain and one or two IL-12 subunit domains, as outlined herein.

By "position" as used herein is meant a location in the sequence of a protein. Positions may be numbered sequentially, or according to an established format, for example the EU index for antibody numbering.

By "strandedness" in the context of the monomers of the heterodimeric proteins of the invention herein is meant that, similar to the two strands of DNA that "match", heterodimerization variants are incorporated into each monomer so as to preserve, create, and/or enhance the ability to "match" to form heterodimers. For example, if some pI variants are engineered into monomer A (e.g. making the pI higher), then steric variants that are "charge pairs" that can be utilized as well do not interfere with the pI variants, e.g. the charge variants that make a pI higher are put on the same "strand" or "monomer" to preserve both functionalities. Similarly, for "skew" variants that come in pairs of a set as more fully outlined below, the skilled artisan will consider pI in deciding into which strand or monomer that incorporates one set of the pair will go, such that pI separation is maximized using the pI of the skews as well.

By "wild type or WT" herein is meant an amino acid sequence or a nucleotide sequence that is found in nature, including allelic variations. A WT protein has an amino acid sequence or a nucleotide sequence that has not been intentionally modified.

The heterodimeric proteins of the present invention are generally isolated or recombinant. "Isolated," when used to describe the various polypeptides disclosed herein, means a polypeptide that has been identified and separated and/or recovered from a cell or cell culture from which it was expressed. Ordinarily, an isolated polypeptide will be prepared by at least one purification step. An "isolated protein," refers to a protein which is substantially free of other proteins from a cell culture such as host cell proteins. "Recombinant" means the proteins are generated using recombinant nucleic acid techniques in exogeneous host cells.

"Percent (%) amino acid sequence identity" with respect to a protein sequence is defined as the percentage of amino acid residues in a candidate sequence that are identical with the amino acid residues in the specific (parental) sequence, after aligning the sequences and introducing gaps, if necessary, to achieve the maximum percent sequence identity, and not considering any conservative substitutions as part of the sequence identity. Alignment for purposes of determining percent amino acid sequence identity can be achieved in various ways that are within the skill in the art, for instance, using publicly available computer software such as BLAST, BLAST-2, ALIGN or Megalign (DNASTAR) software. Those skilled in the art can determine appropriate parameters for measuring alignment, including any algorithms needed to achieve maximal alignment over the full length of the sequences being compared. One particular program is the ALIGN-2 program outlined at paragraphs [0279] to [0280] of US Pub. No. 20160244525, hereby incorporated by reference.

The degree of identity between an amino acid sequence of the present invention ("invention sequence") and the parental amino acid sequence is calculated as the number of exact matches in an alignment of the two sequences, divided by the length of the "invention sequence," or the length of the parental sequence, whichever is the shortest. The result is expressed in percent identity.

In some embodiments, two or more amino acid sequences are at least 50%, 60%, 70%, 80%, or 90% identical. In some embodiments, two or more amino acid sequences are at least 95%, 97%, 98%, 99%, or even 100% identical.

By "IL-12p40 subunit domain" herein is meant the p-chain (the p40 subunit; IL-12p40). As discussed herein, the IL-12p40 subunit domain can be a wildtype human sequence (e.g. SEQ ID NO:3 from FIG. 1), a wildtype human mature form sequence (e.g. SEQ ID NO:4 from FIG. 1) or a variant thereof, as more fully discussed below (e.g. see FIGS. 20, 23 and 29, for example).

By "IL-12p35 subunit domain" herein is meant α-chain (the p35 subunit; IL-12p35). As discussed herein, the IL-12p35 subunit domain can be a wildtype human full-length sequence (e.g. SEQ ID NO:1 from FIG. 1), a wildtype human mature form sequence (e.g. SEQ ID NO:2 from FIG. 1) or a variant thereof, as more fully discussed below (e.g. see FIGS. 20, 23 and 29, for example).

The IL-12 subunit domains of the invention, when associated together, specifically bind to a dimeric IL-12 receptor complex comprising IL-12 receptor β1 and IL-12 receptor β2. The strength, or affinity, of specific binding can be expressed in terms of dissociation constant ($K_D$) of the interaction, wherein a smaller $K_D$ represents greater affinity and a larger $K_D$ represents lower affinity. Binding properties can be determined by methods well known in the art such as bio-layer interferometry and surface plasmon resonance based methods, including Biacore and Octet methodologies. One such method entails measuring the rates of antigen-binding site/antigen or receptor/ligand complex association and dissociation, wherein rates depend on the concentration of the complex partners, the affinity of the interaction, and geometric parameters that equally influence the rate in both directions. Thus, both the association rate ($k_a$) and the dissociation rate ($k_d$) can be determined, and the ratio of $k_d/k_a$ is equal to the dissociation constant $K_D$ (See Nature 361:186-187 (1993) and Davies et al. (1990) Annual Rev Biochem 59:439-473), both of which are incorporated by reference in their entirety for the methods therein.

Specific binding for a particular molecule can be exhibited, for example, by a molecule having a $K_D$ for a ligand (generally a receptor, in this case) of at least about $10^{-4}$ M, at least about $10^{-5}$ M, at least about $10^{-6}$ M, at least about $10^{-7}$ M, at least about $10^{-8}$ M, at least about $10^{-9}$ M, alternatively at least about $10^{-10}$ M, at least about $10^{-11}$ M, at least about $10^{-12}$ M, or greater. Typically, a molecule that specifically binds its receptor will have a $K_D$ that is 20-, 50-, 100-, 500-, 1000-, 5,000-, 10,000- or more times greater for a control molecule relative to the receptor.

Also, specific binding for a particular molecule can be exhibited, for example, by a molecule having a $k_a$ or association rate for a ligand or receptor of at least 20-, 50-, 100-, 500-, 1000-, 5,000-, 10,000- or more times greater for the receptor relative to a control.

By "fused" or "covalently linked" is herein meant that the components (e.g., an IL-12 subunit and an Fc domain) are linked by peptide bonds, either directly or indirectly via domain linkers, outlined herein.

As used herein, the term "single-chain" refers to a molecule comprising amino acid domains linearly linked by peptide bonds. In certain embodiments, the biologically functional IL-12 is a single chain IL-12 complex or "scIL-12", i.e. the IL-12p35 subunit and the IL-12p40 subunit are fused to form a single peptide chain. In a particular such embodiment, the C-terminus of the IL-12p35 subunit is connected to the N-terminus of the IL-12p40 subunit, designated "scIL-12(p35/p40)". In some instances, the C-terminus of the IL-12p35 subunit is connected directly to the N-terminus of the IL-12p40 subunit. In other instances, the C-terminus of the IL-12p35 subunit is connected via a linker to the N-terminus of the IL-12p40 subunit.

In another particular such embodiment, the C-terminus of the IL-12p40 subunit is connected to the N-terminus of the IL-12p35 subunit, designated "scIL-12(p40/p35)". In some cases, the C-terminus of the IL-12p40 subunit is connected directly to the N-terminus of the IL-12p35 subunit. In other cases, the C-terminus of the IL-12p40 subunit is connected via a linker to the N-terminus of the IL-12p35 subunit. Additionally, when these complexes are further fused to an Fc domain, they are still a "single chain". It should be noted that these single chain constructs, where the p35 and p40 subunits are on the same amino acid chain, still are part of a heterodimeric complex containing two amino acid chains (e.g. the scIL-12(p35/p40) component and the "empty arm" Fc component). That is, there are two single chains that make up the heterodimeric complex.

The fusion proteins of the invention can take on a variety of formats, including heterodimeric formats such as those depicted in FIGS. 79A-79E. As described above, the IL-12p35 and IL-12p40 subunits as depicted in such figures can be interchanged.

III. Heterodimeric Fc Fusion Proteins

In some aspects, the present invention relates to targeted heterodimeric Fc fusion proteins that include an antigen binding domain, an Fc region, generally linked (optionally through a domain linker) to one or more different IL-12 protein domains. In one aspect, the heterodimeric Fc fusion protein is an IL-12 heterodimeric Fc fusion protein that includes IL-12p40 and IL-12p35 subunits in different orientations, such that they present together to bind to the IL-12 receptor complex of IL-12Rβ1/β2. The Fc domains can be derived from IgG Fc domains, e.g., IgG1, IgG2, IgG3 or IgG4 Fc domains, with IgG1 and IgG4 Fc domains finding particular use in the invention. As described herein, IgG1 Fc domains may be used, often, but not always in conjunction with ablation variants to ablate effector function. Similarly, when low effector function is desired, IgG4 Fc domains may be used.

As described herein and known in the art, the targeted IL-12 heterodimeric proteins of the invention comprise different domains, which can be overlapping as well. These domains include, but are not limited to, the Fc domain, the CH2 domain, the CH3 domain and the hinge domain, an IL-12p40 subunit domain and an IL-12p35 subunit domain. As described herein, these domains are linked together in different formats, as generally outlined in FIGS. 79A-79E.

In some of the embodiments herein, when a protein fragment, e.g., IL-12p40 or IL-12p35 is attached to an Fc domain, it is the C-terminus of the protein fragment that is attached to all or part of the hinge of the Fc domain; for example, it is generally attached to the sequence EPKS (SEQ ID NO: 833) which is the beginning of the IgG1 hinge. In other of the embodiments herein, when a protein fragment, e.g., IL-12p40 or IL-12p35 is attached to an Fc domain, it is the N-terminus of the protein fragment that is attached to the C-terminus of the CH3 domain.

In some of the constructs and sequences outlined herein of an Fc domain protein, the C-terminus of the IL-12p40 or IL-12p35 protein fragment is attached to the N-terminus of a domain linker, the C-terminus of which is attached to the N-terminus of a constant Fc domain (N-IL-12p40 or IL-12p35 protein fragment-linker-Fc domain-C) although that can be switched (N-Fc domain-linker-IL-12p40 or IL-12p35 protein fragment-C). In other constructs and sequences outlined herein, the C-terminus of a first protein fragment is attached to the N-terminus of a second protein fragment, optionally via a domain linker, the C-terminus of the second protein fragment is attached to the N-terminus of a constant Fc domain, optionally via a domain linker. In yet another construct, the N-terminus of a first protein fragment is attached to the C-terminus of a second protein fragment, optionally via a domain linker, the N-terminus of the second protein fragment is attached to the C-terminus of a constant Fc domain, optionally via a domain linker. In yet other constructs and sequences outlined herein, a constant Fc domain that is not attached to a first protein fragment or a second protein fragment is provided. A heterodimer Fc fusion protein can contain two or more of the exemplary monomeric Fc domain proteins described herein.

In some embodiments, the linker is a "domain linker", used to link any two domains as outlined herein together, some of which are depicted in FIG. 6. While any suitable linker can be used, many embodiments utilize a glycine-serine polymer, including for example (GS)n, (GSGGS)n (SEQ ID NO: 838), (GGGGS)n (SEQ ID NO: 9), and (GGGS)n (SEQ ID NO: 840), where n is an integer of at least one (and generally from 0 to 1 to 2 to 3 to 4 to 5) as well as any peptide sequence that allows for recombinant attachment of the two domains with sufficient length and flexibility to allow each domain to retain its biological function. In some cases, and with attention being paid to "strandedness", as outlined below, the linker is a charged domain linker. In some embodiments, the domain linker utilizes a glycine-alanine polymer, including for example (GA)n, (GAGGA)n (SEQ ID NO: 841), (GGGGA)n (SEQ ID NO: 247), and (GGGA)n (SEQ ID NO: 843), where n is an integer of at least one (and generally from 0 to 1 to 2 to 3 to 4 to 5 to 6 to 7 to 8 to 9 to 10) as well as any peptide sequence that allows for recombinant attachment of the two domains with sufficient length and flexibility to allow each domain to retain its biological function. Illustrative embodiments of domain linkers are depicted in FIG. 6. It has been previously reported that the serine residue in Gly-Ser linkers in Fc fusion proteins may be subject to O-glycosylation. In some instance, a domain linker comprising Gly-Ala decreases heterogeneity in the context of making or producing Fc fusions.

Accordingly, in some embodiments the present invention provides heterodimeric Fc fusion proteins that rely on the use of two different heavy chain variant Fc sequences, that will self-assemble to form a heterodimeric Fc domain fusion polypeptide. In one embodiment, heterodimeric Fc fusion proteins contain at least two constant domains which can be engineered to produce heterodimers, such as pI engineering. Other Fc domains that can be used include fragments that contain one or more of the CH1, CH2, CH3, and hinge domains of the invention that have been pI engineered. In particular, the formats depicted in FIGS. 8A-8F are heterodimeric Fc fusion proteins, meaning that the protein has two associated Fc sequences self-assembled into a heterodimeric Fc domain and at least one protein fragment (e.g., 1, 2 or more protein fragments). In some cases, a first protein fragment is linked to a first Fc sequence and a second protein fragment is linked to a second Fc sequence. In some cases, the heterodimeric Fc fusion protein contains a first protein fragment linked to a second protein fragment which is linked to a first Fc sequence, and a second Fc sequence that is not linked to either the first or second protein fragments.

The present invention is directed to novel constructs to provide heterodimeric Fc fusion proteins that allow binding to one or more binding partners, ligands or receptors. The heterodimeric Fc fusion constructs are based on the self-assembling nature of the two Fc domains of the heavy chains of antibodies, e.g., two "monomers" that assemble into a "dimer". Heterodimeric Fc fusions are made by altering the amino acid sequence of each monomer as more fully discussed below. Thus, the present invention is generally directed to the creation of heterodimeric Fc fusion proteins which can co-engage binding partner(s) or ligand(s) or receptor(s) in several ways, relying on amino acid variants in the constant regions that are different on each chain to promote heterodimeric formation and/or allow for ease of purification of heterodimers over the homodimers. There are a number of mechanisms that can be used to generate the heterodimers of the present invention. In addition, as will be appreciated by those in the art, these mechanisms can be combined to ensure high heterodimerization. Thus, amino acid variants that lead to the production of heterodimers are referred to as "heterodimerization variants". As discussed below, heterodimerization variants can include steric variants (e.g. the "knobs and holes" or "skew" variants described below and the "charge pairs" variants described below) as well as "pI variants", which allows purification of homodimers away from heterodimers. As is generally described in WO2014/145806, hereby incorporated by reference in its entirety and specifically as below for the discussion of "heterodimerization variants", useful mechanisms for heterodimerization include "knobs and holes" ("KIH"; sometimes described herein as "skew" variants (see discussion in WO2014/145806)), "electrostatic steering" or "charge pairs" as described in WO2014/145806, pI variants as described in WO2014/145806, and general additional Fc variants as outlined in WO2014/145806 and below.

In the present invention, there are several basic mechanisms that can lead to ease of purifying heterodimeric proteins and antibodies; one relies on the use of pI variants, such that each monomer, and subsequently each dimeric species, has a different pI, thus allowing the isoelectric purification of A-A, A-B and B-B dimeric proteins. Alternatively, some formats also allow separation on the basis of size. As is further outlined below, it is also possible to "skew" the formation of heterodimers over homodimers. Thus, a combination of steric heterodimerization variants and pI or charge pair variants find particular use in the invention.

In general, embodiments of particular use in the present invention rely on sets of variants that include skew variants, that encourage heterodimerization formation over homodimerization formation, coupled with pI variants, which increase the pI difference between the two monomers and each dimeric species.

Additionally, as more fully outlined below, depending on the format of the heterodimer Fc fusion protein, pI variants can be either contained within the constant and/or Fc domains of a monomer, or domain linkers can be used. That is, the invention provides pI variants that are on one or both of the monomers, and/or charged domain linkers as well. In addition, additional amino acid engineering for alternative functionalities may also confer pI changes, such as Fc, FcRn and KO variants.

In the present invention that utilizes pI as a separation mechanism to allow the purification of heterodimeric proteins, amino acid variants can be introduced into one or both of the monomer polypeptides; that is, the pI of one of the monomers (referred to herein for simplicity as "monomer A") can be engineered away from monomer B, or both monomer A and B can be changed, with the pI of monomer A increasing and the pI of monomer B decreasing. As discussed, the pI changes of either or both monomers can be done by removing or adding a charged residue (e.g., a neutral amino acid is replaced by a positively or negatively charged amino acid residue, e.g., glutamine to glutamic acid), changing a charged residue from positive or negative to the opposite charge (e.g. aspartic acid to lysine) or changing a charged residue to a neutral residue (e.g., loss of a charge; lysine to serine.). A number of these variants are shown in the Figures.

Accordingly, this embodiment of the present invention provides for creating a sufficient change in pI in at least one of the monomers such that heterodimers can be separated from homodimers. As will be appreciated by those in the art, and as discussed further below, this can be done by using a "wild type" heavy chain constant region and a variant region that has been engineered to either increase or decrease its pI (wt A:B+ or wt A:B-), or by increasing one region and decreasing the other region (A+:B- or A-:B+).

Thus, in general, a component of some embodiments of the present invention are amino acid variants in the constant regions that are directed to altering the isoelectric point (pI) of at least one, if not both, of the monomers of a dimeric protein by incorporating amino acid substitutions ("pI variants" or "pI substitutions") into one or both of the monomers. The separation of the heterodimers from the two homodimers can be accomplished if the pIs of the two monomers differ by as little as 0.1 pH unit, with 0.2, 0.3, 0.4 and 0.5 or greater all finding use in the present invention.

As will be appreciated by those in the art, the number of pI variants to be included on each or both monomer(s) to get good separation will depend in part on the starting pI of the components. That is, to determine which monomer to engineer or in which "direction" (e.g., more positive or more negative), the sequences of the Fc domains, and in some cases, the protein domain(s) linked to the Fc domain are calculated and a decision is made from there. As is known in the art, different Fc domains and/or protein domains will have different starting pIs which are exploited in the present invention. In general, as outlined herein, the pIs are engineered to result in a total pI difference of each monomer of at least about 0.1 logs, with 0.2 to 0.5 being preferred as outlined herein.

Furthermore, as will be appreciated by those in the art and outlined herein, in some embodiments, heterodimers can be separated from homodimers on the basis of size. As shown in the Figures, for example, several of the formats allow separation of heterodimers and homodimers on the basis of size.

In the case where pI variants are used to achieve heterodimerization, by using the constant region(s) of Fc domains(s), a more modular approach to designing and purifying heterodimeric Fc fusion proteins is provided. Thus, in some embodiments, heterodimerization variants (including skew and purification heterodimerization variants) must be engineered. In addition, in some embodiments, the possibility of immunogenicity resulting from the pI variants is significantly reduced by importing pI variants from different IgG isotypes such that pI is changed without introducing significant immunogenicity. Thus, an additional problem to be solved is the elucidation of low pI constant domains with high human sequence content, e.g. the minimization or avoidance of non-human residues at any particular position.

A side benefit that can occur with this pI engineering is also the extension of serum half-life and increased FcRn binding. That is, as described in U.S. Ser. No. 13/194,904 (incorporated by reference in its entirety), lowering the pI of antibody constant domains (including those found in antibodies and Fc fusions) can lead to longer serum retention in vivo. These pI variants for increased serum half life also facilitate pI changes for purification.

In addition, it should be noted that the pI variants of the heterodimerization variants give an additional benefit for the analytics and quality control process of Fc fusion proteins, as the ability to either eliminate, minimize and distinguish when homodimers are present is significant. Similarly, the ability to reliably test the reproducibility of the heterodimeric Fc fusion protein production is important.

A. Heterodimerization Variants

The present invention provides heterodimeric proteins, including heterodimeric Fc fusion proteins in a variety of formats, which utilize heterodimeric variants to allow for heterodimer formation and/or purification away from homodimers. The heterodimeric fusion constructs are based on the self-assembling nature of the two Fc domains, e.g., two "monomers" that assemble into a "dimer".

There are a number of suitable pairs of sets of heterodimerization skew variants. These variants come in "pairs" of "sets". That is, one set of the pair is incorporated into the first monomer and the other set of the pair is incorporated into the second monomer. It should be noted that these sets do not necessarily behave as "knobs in holes" variants, with a one-to-one correspondence between a residue on one monomer and a residue on the other; that is, these pairs of sets form an interface between the two monomers that encourages heterodimer formation and discourages homodimer formation, allowing the percentage of heterodimers that spontaneously form under biological conditions to be over 90%, rather than the expected 50% (25% homodimer A/A: 50% heterodimer A/B:25% homodimer B/B).

B. Steric Variants

In some embodiments, the formation of heterodimers can be facilitated by the addition of steric variants. That is, by changing amino acids in each heavy chain, different heavy chains are more likely to associate to form the heterodimeric structure than to form homodimers with the same Fc amino acid sequences. Suitable steric variants are included in the FIG. 29 of U.S. Ser. No. 15/141,350, all of which is hereby incorporated by reference in its entirety, as well as in FIG. 2.

One mechanism is generally referred to in the art as "knobs and holes", referring to amino acid engineering that creates steric influences to favor heterodimeric formation and disfavor homodimeric formation, as described in U.S. Ser. No. 61/596,846, Ridgway et al., Protein Engineering 9(7):617 (1996); Atwell et al., J. Mol. Biol. 1997 270:26; U.S. Pat. No. 8,216,805, all of which are hereby incorporated by reference in their entirety. The Figures identify a number of "monomer A-monomer B" pairs that rely on "knobs and holes". In addition, as described in Merchant et al., Nature Biotech. 16:677 (1998), these "knobs and hole" mutations can be combined with disulfide bonds to skew formation to heterodimerization.

An additional mechanism that finds use in the generation of heterodimers is sometimes referred to as "electrostatic steering" as described in Gunasekaran et al., J. Biol. Chem. 285(25):19637 (2010), hereby incorporated by reference in its entirety. This is sometimes referred to herein as "charge pairs". In this embodiment, electrostatics are used to skew the formation towards heterodimerization. As those in the art will appreciate, these may also have an effect on pI, and thus on purification, and thus could in some cases also be considered pI variants. However, as these were generated to force heterodimerization and were not used as purification tools, they are classified as "steric variants". These include, but are not limited to, D221E/P228E/L368E paired with D221R/P228R/K409R (e.g., these are "monomer" corresponding sets) and C220E/P228E/368E paired with C220R/E224R/P228R/K409R.

Additional monomer A and monomer B variants can be combined with other variants, optionally and independently in any amount, such as pI variants outlined herein or other steric variants that are shown in FIG. 37 of US 2012/0149876, all of which are incorporated expressly by reference herein.

In some embodiments, the steric variants outlined herein can be optionally and independently incorporated with any pI variant (or other variants such as Fc variants, FcRn variants, etc.) into one or both monomers, and can be independently and optionally included or excluded from the proteins of the invention.

A list of suitable skew variants is found in FIG. 2. Of particular use in many embodiments are the pairs of sets including, but not limited to, S364K/E357Q:L368D/K370S; L368D/K370S:S364K; L368E/K370S:S364K; T411E/K360E/Q362E:D401K; L368D/K370S:S364K/E357L; K370S:S364K/E357Q; and T366S/L368A/Y407V:T366W (optionally including a bridging disulfide, T366S/L368A/Y407V/Y349C:T366W/S354C). In terms of nomenclature, the pair "S364K/E357Q:L368D/K370S" means that one of the monomers has the double variant set S364K/E357Q and the other has the double variant set L368D/K370S; as above, the "strandedness" of these pairs depends on the starting pI.

C. pI (Isoelectric Point) Variants for Heterodimers

In general, as will be appreciated by those in the art, there are two general categories of pI variants: those that increase the pI of the protein (basic changes) and those that decrease the pI of the protein (acidic changes). As described herein, all combinations of these variants can be used: one monomer may be wild type, or a variant that does not display a significantly different pI from wildtype, and the other can be either more basic or more acidic. Alternatively, each monomer may be changed, one to more basic and one to more acidic.

Preferred combinations of pI variants are shown in FIG. 30 of U.S. Ser. No. 15/141,350, all of which are herein incorporated by reference in its entirety. As outlined herein and shown in the figures, these changes are shown relative to IgG1, but all isotypes can be altered this way, as well as isotype hybrids. In the case where the heavy chain constant domain is from IgG2-4, R133E and R133Q can also be used.

In one embodiment, a preferred combination of pI variants has one monomer comprising 208D/295E/384D/418E/421D variants (N208D/Q295E/N384D/Q418E/N421D when relative to human IgG1) if one of the Fc monomers includes a CH1 domain. In some instances, the second monomer comprising a positively charged domain linker, including (GKPGS)$_4$ (SEQ ID NO: 844). In some cases, the first monomer includes a CH1 domain, including position 208. Accordingly, in constructs that do not include a CH1 domain (for example for heterodimeric Fc fusion proteins that do not utilize a CH1 domain on one of the domains), a preferred negative pI variant Fc set includes 295E/384D/418E/421D variants (Q295E/N384D/Q418E/N421D when relative to human IgG1).

In some embodiments, mutations are made in the hinge of the Fc domain, including positions 216, 217, 218, 219, 220, 221, 222, 223, 224, 225, 226, 227, 228, 229, and 230. Thus, pI mutations and particularly substitutions can be made in one or more of positions 216-230, with 1, 2, 3, 4 or 5 mutations finding use in the present invention. Again, all possible combinations are contemplated, alone or with other pI variants in other domains.

Specific substitutions that find use in lowering the pI of hinge domains include, but are not limited to, a deletion at position 221, a non-native valine or threonine at position 222, a deletion at position 223, a non-native glutamic acid at position 224, a deletion at position 225, a deletion at position 235 and a deletion or a non-native alanine at position 236. In some cases, only pI substitutions are done in the hinge domain, and in others, these substitution(s) are added to other pI variants in other domains in any combination.

In some embodiments, mutations can be made in the CH2 region, including positions 233, 234, 235, 236, 274, 296, 300, 309, 320, 322, 326, 327, 334 and 339. It should be noted that changes in 233-236 can be made to increase effector function (along with 327A) in the IgG2 backbone. Again, all possible combinations of these 14 positions can be made; e.g., a pI antibody may have 1, 2, 3, 4, 5, 6, 7, 8, 9 or 10 CH2 pI substitutions.

Specific substitutions that find use in lowering the pI of CH2 domains include, but are not limited to, a non-native glutamine or glutamic acid at position 274, a non-native phenylalanine at position 296, a non-native phenylalanine at position 300, a non-native valine at position 309, a non-native glutamic acid at position 320, a non-native glutamic acid at position 322, a non-native glutamic acid at position 326, a non-native glycine at position 327, a non-native glutamic acid at position 334, a non-native threonine at position 339, and all possible combinations within CH2 and with other domains.

In this embodiment, the mutations can be independently and optionally selected from position 355, 359, 362, 384, 389,392, 397, 418, 419, 444 and 447. Specific substitutions that find use in lowering the pI of CH3 domains include, but are not limited to, a non-native glutamine or glutamic acid at position 355, a non-native serine at position 384, a non-native asparagine or glutamic acid at position 392, a non-native methionine at position 397, a non-native glutamic acid at position 419, a non-native glutamic acid at position 359, a non-native glutamic acid at position 362, a non-native glutamic acid at position 389, a non-native glutamic acid at position 418, a non-native glutamic acid at position 444, and a deletion or non-native aspartic acid at position 447.

D. Isotypic Variants

In addition, many embodiments of the invention rely on the "importation" of pI amino acids at particular positions from one IgG isotype into another, thus reducing or eliminating the possibility of unwanted immunogenicity being introduced into the variants. A number of these are shown in FIG. 21 of US Publ. App. No. 2014/0370013, hereby incorporated by reference. That is, IgG1 is a common isotype for therapeutic antibodies for a variety of reasons, including high effector function. However, the heavy constant region of IgG1 has a higher pI than that of IgG2 (8.10 versus 7.31). By introducing IgG2 residues at particular positions into the IgG1 backbone, the pI of the resulting monomer is lowered (or increased) and additionally exhibits longer serum half-life. For example, IgG1 has a glycine (pI 5.97) at position 137, and IgG2 has a glutamic acid (pI 3.22); importing the glutamic acid will affect the pI of the resulting protein. As is described below, a number of amino acid substitutions are generally required to significantly affect the pI of the variant Fc fusion protein. However, it should be noted as discussed below that even changes in IgG2 molecules allow for increased serum half-life.

In other embodiments, non-isotypic amino acid changes are made, either to reduce the overall charge state of the resulting protein (e.g., by changing a higher pI amino acid to a lower pI amino acid), or to allow accommodations in structure for stability, etc. as is more further described below.

In addition, by pI engineering both the heavy and light constant domains, significant changes in each monomer of the heterodimer can be seen. As discussed herein, having the pIs of the two monomers differ by at least 0.5 can allow separation by ion exchange chromatography or isoelectric focusing, or other methods sensitive to isoelectric point.

E. Calculating pI

The pI of each monomer can depend on the pI of the variant heavy chain constant domain and the pI of the total monomer, including the variant heavy chain constant domain and the fusion partner. Thus, in some embodiments, the change in pI is calculated on the basis of the variant heavy chain constant domain, using the chart in the FIG. 19 of US Publ. App. No. 2014/0370013. As discussed herein, which monomer to engineer is generally decided by the inherent pI of each monomer.

F. pI Variants that Also Confer Better FcRn In Vivo Binding

In the case where the p1 variant decreases the p1 of the monomer, they can have the added benefit of improving serum retention in vivo.

Although still under examination, Fc regions are believed to have longer half-lives in vivo, because binding to FcRn at pH 6 in an endosome sequesters the Fc (Ghetie and Ward, 1997 Immunol Today. 18(12): 592-598, entirely incorporated by reference). The endosomal compartment then recycles the Fc to the cell surface. Once the compartment opens to the extracellular space, the higher pH, ~7.4, induces the release of Fc back into the blood. In mice, Dall'Acqua et al. showed that Fc mutants with increased FcRn binding at pH 6 and pH 7.4 actually had reduced serum concentrations and the same half-life as wildtype Fc (Dall'Acqua et al. 2002, J. Immunol. 169:5171-5180, entirely incorporated by reference). The increased affinity of Fc for FcRn at pH 7.4 is thought to forbid the release of the Fc back into the blood. Therefore, the Fc mutations that will increase Fc's half-life in vivo will ideally increase FcRn binding at the lower pH while still allowing release of Fc at higher pH. The amino acid histidine changes its charge state in the pH range of 6.0 to 7.4. Therefore, it is not surprising to find His residues at important positions in the Fc/FcRn complex.

There are a number of Fc substitutions that find use in increased binding to the FcRn and increased serum half-life, as specifically disclosed in U.S. Ser. No. 12/341,769, hereby incorporated by reference in its entirety, including, but not limited to, 434S, 434A, 428L, 308F, 259I, 428L/434S, 259I/308F, 436I/428L, 436I, 252Y/428L, 252Y/434S, 428L/434S, 436V/428L and 259I/308F/428L G. Additional Fc Variants for Additional Functionality In addition to p1 amino acid variants, there are a number of useful Fc amino acid modification that can be made for a variety of reasons, including, but not limited to, altering binding to one or more FcγR, altered binding to FcRn, etc.

Accordingly, the proteins of the invention can include amino acid modifications, including the heterodimerization variants outlined herein, which includes the pI variants and steric variants. Each set of variants can be independently and optionally included or excluded from any particular heterodimeric protein.

H. FcγR Variants

Accordingly, there are a number of useful Fc substitutions that can be made to alter binding to one or more of the Fcγ receptors. Substitutions that result in increased binding as well as decreased binding can be useful. For example, it is known that increased binding to FcγRIIIa results in increased ADCC (antibody dependent cell-mediated cytotoxicity; the cell-mediated reaction wherein nonspecific cytotoxic cells that express FcγRs recognize bound antibody on a target cell and subsequently cause lysis of the target cell). Similarly, decreased binding to FcγRIIb (an inhibitory receptor) can be beneficial as well in some circumstances. Amino acid substitutions that find use in the present invention include those listed in U.S. Ser. No. 11/124,620 (particularly FIG. 41), Ser. No. 11/174,287, 11/396,495, 11/538, 406, all of which are expressly incorporated herein by reference in their entirety and specifically for the variants disclosed therein. Particular variants that find use include, but are not limited to, 236A, 239D, 239E, 332E, 332D, 239D/332E, 267D, 267E, 328F, 267E/328F, 236A/332E, 239D/332E/330Y, 239D, 332E/330L, 243A, 243L, 264A, 264V and 299T.

In addition, amino acid substitutions that increase affinity for FcγRIIc can also be included in the Fc domain variants outlined herein. The substitutions described in, for example, U.S. Ser. Nos. 11/124,620 and 14/578,305 are useful.

I. Ablation Variants

Similarly, another category of functional variants are "FcγR ablation variants" or "Fc knock out (FcKO or KO)" variants. In these embodiments, for some therapeutic applications, it is desirable to reduce or remove the normal binding of the Fc domain to one or more or all of the Fcγ receptors (e.g., FcγR1, FcγRIIa, FcγRIIb, FcγRIIIa, etc.) to avoid additional mechanisms of action. That is, for example, in many embodiments, particularly in the use of immunomodulatory proteins, it is desirable to ablate FcγRIIIa binding to eliminate or significantly reduce ADCC activity such that one of the Fc domains comprises one or more Fcγ receptor ablation variants. These ablation variants are depicted in FIG. 31 of U.S. Ser. No. 15/141,350, all of which are herein incorporated by reference in its entirety, and each can be independently and optionally included or excluded, with preferred aspects utilizing ablation variants selected from the group consisting of G236R/L328R, E233P/L234V/L235A/G236del/S239K, E233P/L234V/L235A/G236del/S267K, E233P/L234V/L235A/G236del/S239K/A327G, E233P/L234V/L235A/G236del/S267K/A327G and E233P/L234V/L235A/G236del, according to the EU index. It should be noted that the ablation variants referenced herein ablate FcγR binding but generally not FcRn binding.

J. Combination of Heterodimeric and Fc Variants

As will be appreciated by those in the art, all of the recited heterodimerization variants (including skew and/or pI variants) can be optionally and independently combined in any way, as long as they retain their "strandedness" or "monomer partition". In addition, all of these variants can be combined into any of the heterodimerization formats.

In the case of pI variants, while embodiments finding particular use are shown in the Figures, other combinations can be generated, following the basic rule of altering the pI difference between two monomers to facilitate purification.

In addition, any of the heterodimerization variants, skew and pI, may also be independently and optionally combined with Fc ablation variants, Fc variants, FcRn variants, as generally outlined herein.

In addition, a monomeric Fc domain can comprise a set of amino acid substitutions that includes C220S/S267K/L368D/K370S or C220S/S267K/S364K/E357Q.

In addition, the heterodimeric Fc fusion proteins can comprise skew variants (e.g., a set of amino acid substitutions as shown in FIGS. 1A-1C of U.S. Ser. No. 15/141,350, all of which are herein incorporated by reference in its entirety), with particularly useful skew variants being selected from the group consisting of S364K/E357Q: L368D/K370S; L368D/K370S:S364K; L368E/K370S: S364K; T411E/K360E/Q362E:D401K; L368D/K370S: S364K/E357L; K370S:S364K/E357Q; T366S/L368A/Y407V:T366W; and T366S/L368A/Y407V:T366W (optionally including a bridging disulfide, T366S/L368A/Y407V/Y349C:T366W/S354C), optionally ablation variants, optionally charged domain linkers; and optionally p1 variants.

In some embodiments, the Fc domain comprises one or more amino acid substitutions selected from the group consisting of: 236R, S239D, S239E, F243L, M252Y, V259I, S267D, S267E, S67K, S298A, V308F, L328F, L328R, 330L, I332D, 1332E, M428L, N434A, N434S, 236R/L328R, S239D/I332E, 236R/L328F, V259I/V308F, S267E/L328F, M428L/N43S, Y436I/M428L, N436V/M428L, V436I/N434S, Y436V/N434S, S239D/I332E/330L, M252Y/S54T/T256E, V259I/V308F/M428L, E233P/L234V/L235A/G236_/S239K, E233P/L234V/L235A/G236_/S239K/A327G, E233P/L234V/L235A/G236_/S267K/A327G, E233P/L234V/L235A/G236, and E233P/L234V/L235A/G236_/S267K according to EU index.

In one embodiment, a particular combination of skew and p1 variants that finds use in the present invention is T366S/L368A/Y407V:T366W (optionally including a bridging disulfide, T366S/L368A/Y407V/Y349C:T366W/S354C) with one monomer comprising Q295E/N384D/Q418E/N481D and the other a positively charged domain linker. As will be appreciated in the art, the "knobs in holes" variants do not change p1, and thus can be used on either monomer.

IV. Interleukin 12

Figure 9B:
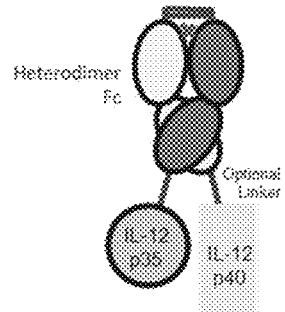

The present invention relates to the biologically functional form of interleukin 12. As stated above, the biologically functional form of interleukin 12 or "IL-12" is a heterodimer, composed of the IL-12p35 subunit (IL-12 subunit alpha) and the IL-12p40 subunit (IL-12 subunit beta), hereon designated as an "IL-12 heterodimeric complex". This complex can be used in two different formats. As shown in FIGS. 9A-B, the IL-12p40 subunit and the IL-12p35 subunits are not covalently attached to each other, but rather are covalently attached respectively to a first and a second Fc domain which are assembled as a heterodimer. Alternatively, the IL-12p35 and IL-12p40 subunits can be covalently attached, optionally using a domain linker (as described herein), as generally shown in FIGS. 9C-F, hereon designated a single-chain IL-12 complex or "scIL-12". The order of the two subunits in the scIL-12 may be designated as follows: "scIL-12(p40/p35)", wherein the IL-12p40 subunit is N-terminally linked (with or without a domain linker) to the IL-12p35 subunit, or "scIL-12(p35/p40)", wherein the IL-12p35 is N-terminally linked (with or without a domain linker) to the IL-12p40 subunit.

In some embodiments, the human IL-12p35 protein has the amino acid sequence set forth in NCBI Ref. Seq. Nos. NP_000873.2, NP_001341511.1, or NP_001341512.1, or SEQ ID NO:1 (human IL-12 subunit alpha (IL-12p35) precursor sequence as depicted in FIG. 1). In some cases, the coding sequence of human IL-12p35 is set forth in NCBI Ref. Seq. Nos. NM_000882.3, NM_001354582.2, or NM_001354583.2. An exemplary IL-12p35 protein of the Fc fusion heterodimeric protein outlined herein can have the amino acid sequence of SEQ ID NO:2 (human IL-12 subunit alpha (IL-12p35) mature form sequence as depicted in FIG. 1) or amino acids 23-219 of SEQ ID NO:1. In some embodiments, the IL-12p35 protein has at least 90%, e.g., 90%, 91%, 92%, 93%, 94%, 95%, 96%, 97%, 98%, 99%, or more sequence identity to SEQ ID NO:2. The IL-12p35 subunit of the Fc fusion protein can have 1, 2, 3, 4, 5, 6, 7, 8 or 9 amino acid mutations.

In some embodiments, the human IL-12p40 protein has the amino acid sequence set forth in NCBI Ref. Seq. No. NP_002178.2 or SEQ ID NO:3 (human IL-12 subunit beta (IL-12p40) precursor sequence as depicted in FIG. 1). In some cases, the coding sequence of human IL-12p40 is set forth in NCBI Ref. Seq. No. NM_002187.3. An exemplary IL-12p40 protein of the Fc fusion protein outlined herein can have the amino acid sequence of SEQ ID NO:4 (Human IL-12 subunit beta (IL-12p40) mature form sequence as depicted in FIG. 1) or amino acids 23-328 of SEQ ID NO:3. In some embodiments, the IL-12p40 protein has at least 90%, e.g., 90%, 91%, 92%, 93%, 94%, 95%, 96%, 97%, 98%, 99%, or more sequence identity to SEQ ID NO:4. The IL-12p40 subunit of the Fc fusion protein can have 1, 2, 3, 4, 5, 6, 7, 8, or 9 amino acid mutations.

The present invention also provides variant IL-12p40 subunits and variant IL-12p35 subunits. These variants find use as part of the biologically functional IL-12 complex as well as any of the IL-12-Fc fusions described herein. Exemplary variant IL-12p40 subunits and amino acid sequences of such are provided in FIG. 21A-FIG. 21G, FIG. 66A-FIG. 66C, and FIG. 89A-89C. Exemplary variant IL-12p35 subunits and amino acid sequences of such are provided in FIG. 24A-FIG. 24C.

A. Expression Variants

As a preliminary matter, the IL-12p40 and IL-12p35 subunits of the invention also include variants to remove potential N-glycosylation sites designed to reduce heterogeneity. IL-12p40 and/or IL-12p35 variants described herein can include one or more deglycosylation (also referred to as aglycosylation) substitutions or modifications.

Such potential N-glycosylation sites on IL-12p40 at which amino acid modifications can be introduced include one or more substitutions selected from the group consisting of N103, N113, N200, and N281 (numbered according to the human IL-12 subunit beta (IL-12p40 mature form sequence as depicted in FIG. 1). Illustrative modifications at these sites include one or more substitutions selected from the group consisting of N103D, N103Q, N113D, N113Q, N200D, N200Q, N281D, and N218Q. IL-12p40 expression variants can include one or more modifications at these sites. In one embodiment, the IL-12p40 variant comprises N103D. In one embodiment, the IL-12p40 variant comprises N103Q. In one embodiment, the IL-12p40 variant comprises N113D. In one embodiment, the IL-12p40 variant comprises N113Q. In one embodiment, the IL-12p40 variant comprises N200D. In one embodiment, the IL-12p40 variant comprises N200Q. In one embodiment, the IL-12p40 variant comprises N281D. In one embodiment, the IL-12p40 variant comprises N281Q. In one embodiment, the IL-12p40 variant comprises N103D/

N113D. In one embodiment, the IL-12p40 variant comprises N103D/N113D/N200D. In one embodiment, the IL-12p40 variant comprises N103D/N113D/N281D. In one embodiment, the IL-12p40 variant comprises N103D/N200D. In one embodiment, the IL-12p40 variant comprises N103D/N200D/N281D. In one embodiment, the IL-12p40 variant comprises N103D/N281D. In one embodiment, the IL-12p40 variant comprises N103D/N113D/N200D/N281D. In one embodiment, the IL-12p40 variant comprises N103Q/N113Q. In one embodiment, the IL-12p40 variant comprises N103Q/N113Q/N200Q. In one embodiment, the IL-12p40 variant comprises N103Q/N113Q/N281Q. In one embodiment, the IL-12p40 variant comprises N103Q/N200Q. In one embodiment, the IL-12p40 variant comprises N103Q/N200Q/N281Q. In one embodiment, the IL-12p40 variant comprises N103Q/N281Q. In one embodiment, the IL-12p40 variant comprises N113D/N200D. In one embodiment, the IL-12p40 variant comprises N113D/N200D/N281D. In one embodiment, the IL-12p40 variant comprises N113D/N281D. In one embodiment, the IL-12p40 variant comprises N113Q/N200Q. In one embodiment, the IL-12p40 variant comprises N113Q/N281Q. In one embodiment, the IL-12p40 variant comprises N113Q/N200Q/N281Q. In one embodiment, the IL-12p40 variant comprises N103Q/N113Q/N200Q/N281Q. In one embodiment, the IL-12p40 variant comprises N200D/N281D. In one embodiment, the IL-12p40 variant comprises N200Q/N281Q. These modifications can be used alone or in combination with any other IL-12p40 variants, such as affinity variants.

Such potential N-glycosylation sites on IL-12p35 at which amino acid modifications can be introduced include one or more substitutions selected from the group consisting of N71, N85, and N195 (numbered according to the human IL-12 subunit alpha (IL-12p35) mature form sequence as depicted in FIG. 1). Illustrative modifications at these sites include one or more substitutions selected from the group consisting of N71D, N71Q, N85D, N85Q, N195D, and N195Q. IL-12p35 variants can include one or more modifications at these sites. In one embodiment, the IL-12p35 variant comprises N71D. In one embodiment, the IL-12p35 variant comprises N71Q. In one embodiment, the IL-12p35 variant comprises N85D. In one embodiment, the IL-12p35 variant comprises N85Q. In one embodiment, the IL-12p35 variant comprises N195D. In one embodiment, the IL-12p35 variant comprises N195Q. In one embodiment, the IL-12p35 variant comprises N71D/N85D. In one embodiment, the IL-12p35 variant comprises N71Q/N85Q. In one embodiment, the IL-12p35 variant comprises N85D/N195D. In one embodiment, the IL-12p35 variant comprises N85Q/N195Q. In one embodiment, the IL-12p35 variant comprises N71D/N195D. In one embodiment, the IL-12p35 variant comprises N71Q/N195Q. In one embodiment, the IL-12p35 variant comprises N71D/N85D/N195D. In one embodiment, the IL-12p35 variant comprises N71Q/N85Q/N195Q. These modifications can be used alone or in combination with any other IL-12p35 variants, such as affinity variants.

In some embodiments, any of the targeted IL-12 proteins include a variant IL-12p35 subunit comprising one or more (e.g., 1, 2, or 3) deglycosylation variants selected from the group consisting of N71, N85, N195, N71D, N85D, N195D, N71Q, N85Q, N195Q and any combination thereof. In some embodiments, any of the targeted IL-12 proteins include a variant IL-12p40 subunit comprising one or more (e.g., 1, 2, 3, or 4) deglycosylation variants selected from the group consisting of N103, N113, N200, N281, N103D, N113D, N200D, N281D, N103Q, N113Q, N200Q, N281Q, and any combination thereof. In some embodiments, a targeted IL-12 proteins described herein includes a wildtype IL-2p40 subunit and a variant IL-12p35 subunit comprising one or more (e.g., 1, 2, or 3) deglycosylation variants selected from the group consisting of N71, N85, N195, N71D, N85D, N195D, N71Q, N85Q, N195Q and any combination thereof. In some embodiments, a targeted IL-12 proteins described herein includes a wildtype IL-12p35 subunit and a targeted IL-12 proteins described herein includes a variant IL-12p40 subunit comprising one or more (e.g., 1, 2, 3, or 4) deglycosylation variants selected from the group consisting of N103, N113, N200, N281, N103D, N113D, N200D, N281D, N103Q, N113Q, N200Q, N281Q, and any combination thereof. In some embodiments, a targeted IL-12 proteins described herein includes a variant IL-12p35 subunit comprising one or more (e.g., 1, 2, or 3) deglycosylation variants selected from the group consisting of N71, N85, N195, N71D, N85D, N195D, N71Q, N85Q, N195Q and any combination thereof and a variant IL-12p40 subunit comprising one or more (e.g., 1, 2, 3, or 4) deglycosylation variants selected from the group consisting of N103, N113, N200, N281, N103D, N113D, N200D, N281D, N103Q, N113Q, N200Q, N281Q, and any combination thereof.

The IL-12p40 subunit has a free cysteine at position 252 (numbered according to the human IL-12 subunit beta (IL-12p40) mature form sequence as depicted in FIG. 1A) which may bond with other free cysteines leading at least to heterogeneity and at worse to immunogenicity. Accordingly, IL-12p40 variants were engineered to remove the free cysteine, for example, by introducing C252S modification (although other substitutions may also be used). Modification of C252 (e.g., C252S) can be used alone or in combination with any other IL-12p40 variants, such as affinity or expression variants. Illustrative IL-12p40 variants comprising a modification at C252 to remove the free cysteine are depicted in FIGS. 65A-65B. Illustrative IL-12-Fc fusions proteins were generated with the additional variant IL-12p40 subunits, sequences for which are depicted in FIGS. 66A-66C, and produced as generally described in Example 1B. These modifications can be used alone or in combination with any other IL-12p40 variants, such as affinity variants.

B. Affinity and Potency Variants

The invention provides IL-12p40 variants and IL-12p35 variants which form biologically functional IL-12 with altered, that is either reduced or increased, binding affinity for IL-12 receptors. In some cases, the variant IL-12p40 subunit has altered, that is either reduced or increased, binding affinity for IL-12 receptor subunit beta-1 (IL-12R (31), IL-12 receptor subunit beta-2 (IL-12R(32), and/or the IL-12 receptor complex. In some cases, the variant IL-12p35 has altered, that is either reduced or increased, binding affinity for IL-12 receptor subunit beta-1 (IL-12R(31), IL-12 receptor subunit beta-2 (IL-12R(32), and/or the IL-12 receptor complex. The invention also provides IL-12p40 variants and IL-12p35 variants which form biologically functional IL-12 with altered, that is either reduced or increased, potency compared to wildtype IL-12p40 and IL-12p35.

Suitable sites on IL-12p40 at which amino acid modifications can be introduced includes those of: E3, D7, E12, D14, W15, P17, D18, A19, P20, G21, E22, M23, D29, E32, E33, D34, L40, D41, Q42, S43, E45, L47, T54, 155, Q56, K58, E59, F60, G61, D62, Q65, Y66, E73, K84, E86, D87, G88, I89, W90, D93, D97, K99, E100, K102, N103, K104, F106, E110, N113, Y114, D129, D142, Q144, E156, R159, D161, N162, K163, D166, D170, Q172, D174, A176, C177, P178, A179, A180, E181, S183, P185, E187, N200, S204, F206, R208, D209, D214, N218, Q220, N226, Q229, E231, E235, T242, P243, S245, Y246, F247, S248, Q256, K158, C252, K260, E262, K264, D265, D270, N281, Q289, D290, R291, Y292, Y293, and E299 (numbered according to the human IL-12 subunit beta (IL-12p40 mature form sequence as depicted in FIG. 1) in any combination. Illustrative modifications at these sites including those of: D18K, D18N, E32Q, E33Q, D34K, D34N, Q42E, S43E, S43K, E45Q, Q56E, E59K, E59Q, D62N, E73Q, D87N, K99E, K99Y, E100Q, N103D, N103Q, N113D, N113Q, Q144E, R159E, D161N, K163E, E187Q, N200D, N200Q, N218Q, Q229E, E235Q, C252S, Q256N, K258E, K260E, E262Q, K264E, N281D, N281Q, and E299Q. IL-12p40 affinity variants can include modifications at one or more of these sites.

The IL-12p40 subunit has a free cysteine at position 252 (numbered according to the human IL-12 subunit beta (IL-12p40) mature form sequence as depicted in FIG. 1A) which may bond with other free cysteines leading at least to heterogeneity and at worse to immunogenicity. Accordingly, IL-12p40 variants were engineered to remove the free cysteine, for example, by introducing C252S modification (although other substitutions may also be used). Modification of C252 (e.g., C252S) can be used alone or in combination with any other IL-12p40 variants, such as affinity or expression variants. Illustrative IL-12p40 variants comprising a modification at C252 to remove the free cysteine are depicted in FIGS. 65A-65B. Illustrative IL-12-Fc fusions proteins were generated with the additional variant IL-12p40 subunits, sequences for which are depicted in FIGS. 66A-66C, and produced as generally described in Example 1B. These modifications can be used alone or in combination with any other IL-12p40 variants, such as affinity variants.

In some embodiments, the IL-12p40 subunit of the targeted IL-12 Fc fusion described herein comprises amino acid substitutions i) E59K/C252S. In some embodiments, the IL-12p40 subunit comprises amino acid substitutions E59K/N200Q. In some embodiments, the IL-12p40 subunit comprises amino acid substitutions E59K/K99E/N200Q. In some embodiments, the IL-12p40 subunit comprises amino acid substitutions E59K/K99Y/N200Q. In some embodiments, the IL-12p40 subunit comprises amino acid substitutions E59K/K99E/N200Q/C252S. In some embodiments, the IL-12p40 subunit comprises amino acid substitutions E59K/K99Y/N200Q/C252S. In some embodiments, the IL-12p40 subunit comprises amino acid substitutions E59K/K99E/N200Q/K264E. In some embodiments, the IL-12p40 subunit comprises amino acid substitutions D18K/E59K/K99E/N200Q. In some embodiments, the IL-12p40 subunit comprises amino acid substitutions D18K/E59K/K99E/C252S. In some embodiments, the IL-12p40 subunit comprises amino acid substitutions. In some embodiments, the IL-12p40 subunit comprises amino acid substitutions D18K/E59K/K99E/N200Q/C252S. D18K/E59K/K99E/N200Q/K264E. In some embodiments, the IL-12p40 subunit comprises amino acid substitutions D18K/E59K/K99E/C252S/K264E. In some embodiments, the IL-12p40 subunit comprises amino acid substitutions D18K/E59K/K99E/N200Q/C252S/K264E.

In one embodiment, the IL-12p40 variant comprises amino acid substitutions D18K/E59K/K99E. In an additional embodiment, the IL-12p40 variant comprises D18K/E59K/K99E/K264E. In an additional embodiment, the IL-12p40 variant comprises D18K/E59Y/K99E. In an additional embodiment, the IL-12p40 variant comprises D18K/E59K/K99E/C252S. In an additional embodiment, the IL-12p40 variant comprises D18K/E59K/K99E/C252S/K264E. In an additional embodiment, the IL-12p40 variant comprises E32K/D34N/E59K/K99E. In an additional embodiment, the IL-12p40 variant comprises E32Q/E59Q. In an additional embodiment, the IL-12p40 variant comprises E32Q/D34N/E59K/K99E. In an additional embodiment, the IL-12p40 variant comprises D34N/E59K. In an additional embodiment, the IL-12p40 variant comprises D34N/E59Q. In an additional embodiment, the IL-12p40 variant comprises D34N/E59K/K99E. In an additional embodiment, the IL-12p40 variant comprises D34K/E59K/K99E. In one embodiment, the IL-12p40 variant comprises Q42E/E45Q. In another embodiment, the IL-12p40 variant comprises E45Q/Q56E. In a further embodiment, the IL-12p40 variant comprises Q42E/E59Q. In yet another embodiment, the IL-12p40 variant comprises Q56E/E59Q. In yet a further embodiment, the IL-12p40 variant comprises Q42E/Q56E/E59Q. In an additional embodiment, the IL-12p40 variant comprises E45Q/Q56E/E59Q. In an additional embodiment, the IL-12p40 variant comprises S43E/E59Q. In an additional embodiment, the IL-12p40 variant comprises S43K/E49Q. In an additional embodiment, the IL-12p40 variant comprises E45K/E59K/K99E. In an additional embodiment, the IL-12p40 variant comprises E59K/K99Y. In an additional embodiment, the IL-12p40 variant comprises E59K/K99E. In an additional embodiment, the IL-12p40 variant comprises E59K/K99E/Q144E. In an additional embodiment, the IL-12p40 variant comprises E59K/K99E/Q144K. In an additional embodiment, the IL-12p40 variant comprises E59K/K99E/R159E. In an additional embodiment, the IL-12p40 variant comprises E59K/K99E/K264E. In an additional embodiment, the IL-12p40 variant comprises E59K/K99E/N103Q/C252S/K264E. In an additional embodiment, the IL-12p40 variant comprises E59K/K99E/N113Q/C252S/K264E. In an additional embodiment, the IL-12p40 variant comprises E59K/K99E/N200Q/C252S/K264E. In an additional embodiment, the IL-12p40 variant comprises E59K/K99E/N281Q/C252S/K264E. In an additional embodiment, the IL-12p40 variant comprises E59K/K99E/N103Q/N113Q/C252S/K264E. In an additional embodiment, the IL-12p40 variant comprises E59K/K99E/N103Q/N200Q/C252S/K264E. In an additional embodiment, the IL-12p40 variant comprises E59K/K99E/N103Q/N281Q/C252S/K264E. In an additional embodiment, the IL-12p40 variant comprises E59K/K99E/N113Q/N200Q/C252S/K264E. In an additional embodiment, the IL-12p40 variant comprises E59K/K99E/N113Q/N281Q/C252S/K264E. E59K/K99E/N200Q/N281Q/C252S/K264E. In an additional embodiment, the IL-12p40 variant comprises E59K/K99E/N103Q/N113Q/N200Q/C252S/K264E. In an additional embodiment, the IL-12p40 variant comprises E59K/K99E/N103Q/N200Q/N281Q/C252S/K264E. In an additional embodiment, the IL-12p40 variant comprises E59K/K99E/N113Q/N200Q/N281Q/C252S/K264E. In an additional embodiment, the IL-12p40 variant comprises E59K/K99E/N103Q/N113Q/N200Q/N281Q/C252S/K264E. In an additional embodiment, the IL-12p40 variant comprises E59Q/K163E. In an additional embodiment, the IL-12p40 variant comprises E59Q/K99E. In an additional embodiment, the IL-12p40 variant comprises E59Q/E187Q. In an additional embodiment, the IL-12p40 variant comprises E59Q/K258E. In an additional embodiment, the IL-12p40 variant comprises E59Q/K260E. In an additional embodiment, the IL-12p40 variant comprises E59Y/K99E. In an additional embodiment, the IL-12p40 variant comprises E59Y/K99Y. In an additional embodiment, the IL-12p40 variant comprises C252S. In an additional embodiment, the IL-12p40 variant comprises E59K/K99Y/C252S. E59K/K99E/C252S/K264E. In an additional embodiment, the IL-12p40 variant comprises E59K/K99E/C252S. In an additional embodiment, the IL-12p40 variant comprises N103D/N113D. In an additional embodiment, the IL-12p40 variant comprises N103D/N200D. In an additional embodiment, the IL-12p40 variant comprises N103D/N281D. In an additional embodiment, the IL-12p40 variant comprises N113D/N200D. In an additional embodiment, the IL-12p40 variant comprises N113D/N281D. N200D/N281D. In an additional embodiment, the IL-12p40 variant comprises N113D/N200D/N281D. In an additional embodiment, the IL-12p40 variant comprises N103Q. In an additional embodiment, the IL-12p40 variant comprises N113Q. In an additional embodiment, the IL-12p40 variant comprises N200Q. In an additional embodiment, the IL-12p40 variant comprises N281Q. In an additional embodiment, the IL-12p40 variant comprises N103D/N113D/N200D. In an additional embodiment, the IL-12p40 variant comprises N103D/N113D/N281D. In an additional embodiment, the IL-12p40 variant comprises N103D/N200D/N281D. In an additional embodiment, the IL-12p40 variant comprises N103Q/N113Q. In an additional embodiment, the IL-12p40 variant comprises N103Q/N200Q. In an additional embodiment, the IL-12p40 variant comprises N103Q/N281Q. In an additional embodiment, the IL-12p40 variant comprises N113Q/N200Q. In an additional embodiment, the IL-12p40 variant comprises N113Q/N281Q. In an additional embodiment, the IL-12p40 variant comprises N200Q/N281Q. In an additional embodiment, the IL-12p40 variant comprises N103Q/N113Q/N200Q. In an additional embodiment, the IL-12p40 variant comprises N103Q/N113Q/N281Q. In an additional embodiment, the IL-12p40 variant comprises N103Q/N200Q/N281Q. In an additional embodiment, the IL-12p40 variant comprises N113Q/N200Q/N281Q. In an additional embodiment, the IL-12p40 variant comprises N103Q/N113Q/N200Q/N281Q. In an additional embodiment, the IL-12p40 variant comprises N103D/N113D/N200D/N281D. Additionally, these modifications can be used alone or in combination with any other IL-12p40 variants, such as expression variants. Exemplary amino acid sequences of an IL-12p40 variant are provided in the figures including FIGS. 66A-66C and 67A-67N as well as the sequence listing.

Suitable sites on IL-12p35 at which amino acid modifications can be introduced are selected from the group consisting of: any one or more selected from the group consisting of Q20, N21, Q35, E38, S44, E45, E46, H49, K54, D55, T59, V60, E61, C63, L64, P65, E67, L68, N71, S73, C74, L75, N76, E79, N85, F96, M97, L89, L124, M125, Q130, Q135, N136, E143, Q146, N151, E153, K158, E162, E163, D165, I171, R181, I182, R183, V185, T186, D188, R189, V190, S192, Y193, and A196 (numbered according to the human IL-12 subunit alpha (IL-12p35) mature form sequence as depicted in FIG. 1). Illustrative modifications are selected from the group consisting of: N21D, Q35D, E38Q, D55Q, D55K, N71D, N71Q, L75A, N76D, E79Q, N85D, N85Q, L89A, F96A, M97A, L124A, M125A, Q130E, Q135E, N136D, E143Q, Q146E, N151D, N151K, E153K, E153Q, K158E, E162Q, E163Q, D165N, I171A, N195D, and N195Q. IL-12p35 affinity variants can include modifications at one or more of these sites.

In one embodiment, the IL-12p35 variant comprises the amino acid substitution N71D. In one embodiment, the IL-12p35 variant comprises N85D. In one embodiment, the IL-12p35 variant comprises N195D. In one embodiment, the IL-12p35 variant comprises N71D/N85D/N195D. In one embodiment, the IL-12p35 variant comprises E153Q. In one embodiment, the IL-12p35 variant comprises E38Q. In one embodiment, the IL-12p35 variant comprises N151D. In one embodiment, the IL-12p35 variant comprises Q135E. In one embodiment, the IL-12p35 variant comprises Q35D. In one embodiment, the IL-12p35 variant comprises Q146E. In one embodiment, the IL-12p35 variant comprises N76D. In one embodiment, the IL-12p35 variant comprises E162Q. In one embodiment, the IL-12p35 variant comprises E163Q. In one embodiment, the IL-12p35 variant comprises N21D. In one embodiment, the IL-12p35 variant comprises D55Q. In one embodiment, the IL-12p35 variant comprises E79Q. In one embodiment, the IL-12p35 variant comprises Q130E. In one embodiment, the IL-12p35 variant comprises N136D. In one embodiment, the IL-12p35 variant comprises E143Q. In one embodiment, the IL-12p35 variant comprises N151K. In one embodiment, the IL-12p35 variant comprises E153K. In one embodiment, the IL-12p35 variant comprises K158E. In one embodiment, the IL-12p35 variant comprises D165N. In one embodiment, the IL-12p35 variant comprises N151D/E153Q. In one embodiment, the IL-12p35 variant comprises amino acid substitutions N151D/D165N. In one embodiment, the IL-12p35 variant comprises Q130E/N151D. In one embodiment, the IL-12p35 variant comprises N151D/K158E. In one embodiment, the IL-12p35 variant comprises E79Q/N151D. In one embodiment, the IL-12p35 variant comprises D55Q/N151D. In one embodiment, the IL-12p35 variant comprises N136D/N151D. In one embodiment, the IL-12p35 variant comprises N21D/N151D. In one embodiment, the IL-12p35 variant comprises E143Q/N151D. In one embodiment, the IL-12p35 variant comprises F96A. In one embodiment, the IL-12p35 variant comprises M97A. In one embodiment, the IL-12p35 variant comprises L89A. In one embodiment, the IL-12p35 variant comprises L124A. In one embodiment, the IL-12p35 variant comprises M125A. In one embodiment, the IL-12p35 variant comprises L75A. In one embodiment, the IL-12p35 variant comprises I171A. In one embodiment, the IL-12p35 variant comprises N71Q. In one embodiment, the IL-12p35 variant comprises N85Q. In one embodiment, the IL-12p35 variant comprises N195Q. In one embodiment, the IL-12p35 variant comprises N71Q/N85Q. In one embodiment, the IL-12p35 variant comprises N71W/N195Q. In one embodiment, the IL-12p35 variant comprises N85Q/N195Q. In one embodiment, the IL-12p35 variant comprises N71Q/N85Q/N195Q. In one embodiment, the IL-12p35 variant comprises N71D/N85D. In one embodiment, the IL-12p35 variant comprises N71D/N195D. In one embodiment, the IL-12p35 variant comprises N85D/N195D. In one embodiment, the IL-12p35 variant comprises D55Q. In one embodiment, the IL-12p35 variant comprises D55K. Additionally, these modifications can be used alone or in combination with any other IL-12p35 variants, such as expression variants.

A biologically functional IL-12 heterodimeric complex can comprise a wildtype IL-12p40 subunit and a wildtype IL-12p35 subunit, a variant IL-12p40 subunit and a wildtype IL-12p35 subunit, a wildtype IL-12p40 subunit and a variant IL-12p35 subunit, or a variant IL-12p40 subunit and a variant IL-12p35 subunit.

In some embodiments, IL-12p40 variants comprise amino acid modifications (e.g., substitutions, additions, and deletions) that remove potential N-glycosylation sites. In some embodiments, IL-12p35 variants comprise amino acid modifications (e.g., substitutions, additions, and deletions) that remove potential N-glycosylation sites. In some embodiments, the IL-12 heterodimeric Fc proteins of the present invention has reduced or decreased glycosylation compared to wildtype IL-12. In some embodiments, the glycosylation status of the IL-12 heterodimeric Fc proteins of the present invention is different than a wildtype IL-12 protein.

Targeted IL-12 heterodimeric Fc proteins comprising a IL-12p40 variant and/or a IL-12p35 variants have reduced or decreased binding affinity to IL-12 receptors compared to a wildtype IL-12, including the p40/p35 heterodimer and the p40 homodimer. Targeted IL-12 heterodimeric Fc proteins of the present invention have reduced or decreased potency compared to wildtype IL-12.

As described in further detail below, targeted IL-12 heterodimeric Fc proteins have prolonged or increased serum half-life. The IL-12 heterodimeric Fc proteins have a reduced or decreased potential for toxicity. IL-12 heterodimeric Fc proteins of the present invention have reduced or decreased potency in inducing STAT4 phosphorylation in immune cells such as, but not limited to, T cells and NK cells.

In some embodiments, the IL-12 heterodimeric Fc proteins of the present invention provide improved pharmacokinetics compared to wildtype IL-12. Also, such IL-12 heterodimeric Fc proteins are therapeutically effective and have an improved therapeutic index such as compared to wildtype IL-12. IL-12 heterodimeric Fc proteins of the present invention can promote or induce T cell activation. In some embodiments, administration of any one of the IL-12 heterodimeric Fc proteins to a patient induces T cell activation in the patient. In some instances, administration induces IFN-gamma secretion in the patient. In some cases, administration of the IL-12 heterodimeric Fc proteins induces expansion of lymphocytes in the patient. In some embodiments, IL-12 heterodimeric Fc proteins are useful for treating cancer such as solid tumor cancers or liquid tumor cancers. In some embodiments, administration of any one of the IL-12 heterodimeric Fc proteins to a patient, and in some cases, in combination with a checkpoint blockage agent reduces tumor size.

V. Domain Linkers

In some embodiments, the IL-12p35 and IL-12p40 subunits are attached together via a linker. Optionally, the subunits are not attached via a linker. In other embodiments, the IL-12p35 and IL-12p40 subunits are noncovalently attached. In some embodiments, the linker between the IL-12p35 and IL-12P40 subunits is linker set forth in FIG. 6, such as but not limited to various glycine-serine linkers and glycine-alanine linkers.

In some embodiments, the IL-12p35 subunit is attached to an Fc domain via a linker. In certain embodiments, the IL-12p35 subunit is attached to an Fc domain directly, such as without a linker. In other embodiments, the IL-12p40 subunit is attached to an Fc domain via a linker. In other embodiments, the IL-12p40 subunit is attached to an Fc domain directly. In some cases, a linker is not used to attach the IL-12p35 subunit or IL-12p40 subunit to an Fc domain.

VI. PD-1 and PD-L1 Antibody Monomers

In some aspects, the present invention relates to IL-12 Fc fusion proteins that bind to human PD-1. In some embodiments, such IL-12 Fc fusion proteins do not compete with therapeutic antibodies for binding to PD-1, such as but not limited to, nivolumab, pembrolizumab, cemiplimab, spartalizumab, camrelizumab, sinitilimab, tislelizumab, toripalimab, AMP-224, AMP-514, and the like.

In other aspects, the present invention relates to IL-12 Fc fusion proteins that bind to human PD-L1. In some embodiments, such IL-12 Fc fusion proteins do not compete with therapeutic antibodies for binding to PD-L1, such as but not limited to, atezolizumab, avelumab, durvalumab, KN035, and the like.

In other aspects, the present invention relates to IL-12 Fc fusion proteins that bind to human RSV.

The heterodimeric Fc fusion protein can include an antibody monomer of any useful antibody format that does not interfere with the activity of therapeutic checkpoint blockage antibodies.

In some embodiments, the antibody monomer includes a Fab or a scFv linked to an Fc domain. In some cases, the PD-1 antibody monomer contains an anti-PD-1(VH)-CH1-Fc and an anti-PD-1 VL-Ckappa. In some cases, the PD-1 antibody monomer contains an anti-PD-1 scFv-Fc. In some cases, the PD-L1 antibody monomer contains an anti-PD-L1(VH)-CH1-Fc and an anti-PD-L1 VL-Ckappa. In some cases, the PD-L1 antibody monomer contains an anti-PD-L1 scFv-Fc.

Amino acid sequences of variable heavy chains and variable light chains of illustrative antibody monomers that competes for PD-1 binding with a therapeutic anti-PD-1 antibody (e.g., nivolumab and/or pembrolizumab) are provided in FIG. 70A-70G. In some cases, the PD-1 antibody monomer comprises a variable heavy chain and a variable light chain of an anti-PD-1 antibody, such as, but is not limited to, 1C11[PD-1], pembrolizumab, nivolizumab, pidilizumab, MK-3475[PD-1], BAP049 clone E[PD-1], BAP049 clone B[PD-1], H7709N [PD-1], H7798N [PD-1], h1H3 Var 6[PD-1], APE2058[PD-1], H005-1 [PD-1], 317-4B6 [PD-1], 326-4A3 [PD-1], hPD-1 mAb 7 [PD-1], Clone 38 [PD-1], Clone 39 [PD-1], Clone 41 [PD-1], Clone 48 [PD-1], PD1-17 [PD-1], PD1-28 [PD-1], PD1-33 [PD-1], PD1-35 [PD-1], LOPD180 [PD-1], Ab948 [PD-1], humanized EH-12.2H7 [PD-1], RG1H10 [PD-1], RG1H10-H2A-22-1S [PD-1], RG1H10-H2A-27-2S [PD-1], RG1H10-3C [PD-1], RG1H10-16C [PD-1], RG1H10-17C [PD-1], RG1H10-19C [PD-1], RG1H10-21C [PD-1], RG1H10-23C2 [PD-1], and mAB7 [PD-1].

Amino acid sequences of of variable heavy chains and variable light chains of illustrative antibody monomers that competes for PD-1 binding with a therapeutic anti-PD-1 antibody (e.g., nivolumab and/or pembrolizumab) are provided in FIGS. 70G-70I.

In some embodiments, the PD-1 antibody monomer comprises a variable heavy chain and a variable light chain of an anti-PD-1 antibody, such as, but is not limited to, mAb A[PD-1]_H1L1, mAb B[PD-1]_H1L1, mAb C[PD-1]_H1L1, and mAb C[PD-1]_H1.19_L10. In some embodiments, the PD-1 antibody monomer utilizes a VH domain (or a CDR1, CDR2, and CDR3 thereof) selected from the group consisting of mAb C[PD-1]_H1, mAb C[PD-1]_H1.19, mAb C[PD-1]_H1.48, mAb C[PD-1]_H1.125, mAb C[PD-1]_H1.130, mAb C[PD-1]_H1.132, mAb C[PD-1]_H1.169, mAb C[PD-1]_H1.175, and mAb C[PD-1]_H2; and a VL domain (or a CDR1, CDR2, and CDR3 thereof) selected from the group consisting of mAb C[PD-1]_11, mAb C[PD-1]_L1.1, mAb C[PD-1]_L1.3, mAb C[PD-1]_L1.45, mAb C[PD-1]_L1.117, mAb C[PD-1]_L1.129, mAb C[PD-1]_L1.135, mAb C[PD-1]_L1.136, mAb C[PD-1]_L1.140, and mAb C[PD-1]_L2.

In some embodiments, the PD-1 antigen binding domain of the targeted IL-12-Fc fusion described herein comprises the variable heavy chain or the CDR1, CDR2, and CDR3 of mAb C_H1 and the variable light chain or the CDR1, CDR2, and CDR3 of mAb C_L1. In one embodiment, PD-1 ABD comprises the variable heavy chain or the CDR1, CDR2, and CDR3 of mAb C_H1 and the variable light chain or the CDR1, CDR2, and CDR3 of mAb C_L1.1. the variable heavy chain or the CDR1, CDR2, and CDR3 of mAb C_H1 and the variable light chain or the CDR1, CDR2, and CDR3 of mAb C_L1.3. In one embodiment, PD-1 ABD comprises the variable heavy chain or the CDR1, CDR2, and CDR3 of mAb C_H1 and the variable light chain or the CDR1, CDR2, and CDR3 of mAb C_L1.45. In one embodiment, PD-1 ABD comprises the variable heavy chain or the CDR1, CDR2, and CDR3 of mAb C_H1 and the variable light chain or the CDR1, CDR2, and CDR3 of mAb C_L1.117. In one embodiment, PD-1 ABD comprises the variable heavy chain or the CDR1, CDR2, and CDR3 of mAb C_H1 and the variable light chain or the CDR1, CDR2, and CDR3 of mAb C_L1.129. In one embodiment, PD-1 ABD comprises the variable heavy chain or the CDR1, CDR2, and CDR3 of mAb C_H1 and the variable light chain or the CDR1, CDR2, and CDR3 of mAb C_L1.135. In one embodiment, PD-1 ABD comprises the variable heavy chain or the CDR1, CDR2, and CDR3 of mAb C_H1 and the variable light chain or the CDR1, CDR2, and CDR3 of mAb C_L1.136. In one embodiment, PD-1 ABD comprises the variable heavy chain or the CDR1, CDR2, and CDR3 of mAb C_H1 and the variable light chain or the CDR1, CDR2, and CDR3 of mAb C_L1.140. In one embodiment, PD-1 ABD comprises the variable heavy chain or the CDR1, CDR2, and CDR3 of mAb C_H1 and the variable light chain or the CDR1, CDR2, and CDR3 of mAb C_L2.

In one embodiment, PD-1 ABD comprises the variable heavy chain or the CDR1, CDR2, and CDR3 of mAb C_H1.19 and the variable light chain or the CDR1, CDR2, and CDR3 of mAb C_L1. In one embodiment, PD-1 ABD comprises the variable heavy chain or the CDR1, CDR2, and CDR3 of mAb C_H1.19 and the variable light chain or the CDR1, CDR2, and CDR3 of mAb C_L1.1. the variable heavy chain or the CDR1, CDR2, and CDR3 of mAb C_H1.19 and the variable light chain or the CDR1, CDR2, and CDR3 of mAb C_L1.3. In one embodiment, PD-1 ABD comprises the variable heavy chain or the CDR1, CDR2, and CDR3 of mAb C_H1.19 and the variable light chain or the CDR1, CDR2, and CDR3 of mAb C_L1.45. In one embodiment, PD-1 ABD comprises the variable heavy chain or the CDR1, CDR2, and CDR3 of mAb C_H1.19 and the variable light chain or the CDR1, CDR2, and CDR3 of mAb C_L1.117. In one embodiment, PD-1 ABD comprises the variable heavy chain or the CDR1, CDR2, and CDR3 of mAb C_H1.19 and the variable light chain or the CDR1, CDR2, and CDR3 of mAb C_L1.129. In one embodiment, PD-1 ABD comprises the variable heavy chain or the CDR1, CDR2, and CDR3 of mAb C_H1.19 and the variable light chain or the CDR1, CDR2, and CDR3 of mAb C_L1.135. In one embodiment, PD-1 ABD comprises the variable heavy chain or the CDR1, CDR2, and CDR3 of mAb C_H1.19 and the variable light chain or the CDR1, CDR2, and CDR3 of mAb C_L1.136. In one embodiment, PD-1 ABD comprises the variable heavy chain or the CDR1, CDR2, and CDR3 of mAb C_H1.19 and the variable light chain or the CDR1, CDR2, and CDR3 of mAb C_L1.140. In one embodiment, PD-1 ABD comprises the variable heavy chain or the CDR1, CDR2, and CDR3 of mAb C_H1.19 and the variable light chain or the CDR1, CDR2, and CDR3 of mAb C_L2.

In one embodiment, PD-1 ABD comprises the variable heavy chain or the CDR1, CDR2, and CDR3 of mAb C_H1.48 and the variable light chain or the CDR1, CDR2, and CDR3 of mAb C_L1. In one embodiment, PD-1 ABD comprises the variable heavy chain or the CDR1, CDR2, and CDR3 of mAb C_H1.48 and the variable light chain or the CDR1, CDR2, and CDR3 of mAb C_L1.1. the variable heavy chain or the CDR1, CDR2, and CDR3 of mAb C_H1.48 and the variable light chain or the CDR1, CDR2, and CDR3 of mAb C_L1.3. In one embodiment, PD-1 ABD comprises the variable heavy chain or the CDR1, CDR2, and CDR3 of mAb C_H1.48 and the variable light chain or the CDR1, CDR2, and CDR3 of mAb C_L1.45. In one embodiment, PD-1 ABD comprises the variable heavy chain or the CDR1, CDR2, and CDR3 of mAb C_H1.48 and the variable light chain or the CDR1, CDR2, and CDR3 of mAb C_L1.117. In one embodiment, PD-1 ABD comprises the variable heavy chain or the CDR1, CDR2, and CDR3 of mAb C_H1.48 and the variable light chain or the CDR1, CDR2, and CDR3 of mAb C_L1.129. In one embodiment, PD-1 ABD comprises the variable heavy chain or the CDR1, CDR2, and CDR3 of mAb C_H1.48 and the variable light chain or the CDR1, CDR2, and CDR3 of mAb C_L1.135. In one embodiment, PD-1 ABD comprises the variable heavy chain or the CDR1, CDR2, and CDR3 of mAb C_H1.48 and the variable light chain or the CDR1, CDR2, and CDR3 of mAb C_L1.136. In one embodiment, PD-1 ABD comprises the variable heavy chain or the CDR1, CDR2, and CDR3 of mAb C_H1.48 and the variable light chain or the CDR1, CDR2, and CDR3 of mAb C_L1.140. In one embodiment, PD-1 ABD comprises the variable heavy chain or the CDR1, CDR2, and CDR3 of mAb C_H1.48 and the variable light chain or the CDR1, CDR2, and CDR3 of mAb C_L2.

In one embodiment, PD-1 ABD comprises the variable heavy chain or the CDR1, CDR2, and CDR3 of mAb C_H1.125 and the variable light chain or the CDR1, CDR2, and CDR3 of mAb C_L1. In one embodiment, PD-1 ABD comprises the variable heavy chain or the CDR1, CDR2, and CDR3 of mAb C_H1.125 and the variable light chain or the CDR1, CDR2, and CDR3 of mAb C_L1.1. the variable heavy chain or the CDR1, CDR2, and CDR3 of mAb C_H1.125 and the variable light chain or the CDR1, CDR2, and CDR3 of mAb C_L1.3. In one embodiment, PD-1 ABD comprises the variable heavy chain or the CDR1, CDR2, and CDR3 of mAb C_H1.125 and the variable light chain or the CDR1, CDR2, and CDR3 of mAb C_L1.45. In one embodiment, PD-1 ABD comprises the variable heavy chain or the CDR1, CDR2, and CDR3 of mAb C_H1.125 and the variable light chain or the CDR1, CDR2, and CDR3 of mAb C_L1.117. In one embodiment, PD-1 ABD comprises the variable heavy chain or the CDR1, CDR2, and CDR3 of mAb C_H1.125 and the variable light chain or the CDR1, CDR2, and CDR3 of mAb C_L1.129. In one embodiment, PD-1 ABD comprises the variable heavy chain or the CDR1, CDR2, and CDR3 of mAb C_H1.125 and the variable light chain or the CDR1, CDR2, and CDR3 of mAb C_L1.135. In one embodiment, PD-1 ABD comprises the variable heavy chain or the CDR1, CDR2, and CDR3 of mAb C_H1.125 and the variable light chain or the CDR1, CDR2, and CDR3 of mAb C_L1.136. In one embodiment, PD-1 ABD comprises the variable heavy chain or the CDR1, CDR2, and CDR3 of mAb C_H1.125 and the variable light chain or the CDR1, CDR2, and CDR3 of mAb C_L1.140. In one embodiment, PD-1 ABD comprises the variable heavy chain or the CDR1, CDR2, and CDR3 of mAb C_H1.125 and the variable light chain or the CDR1, CDR2, and CDR3 of mAb C_L2.

In one embodiment, PD-1 ABD comprises the variable heavy chain or the CDR1, CDR2, and CDR3 of mAb C_H1.130 and the variable light chain or the CDR1, CDR2, and CDR3 of mAb C_L1. In one embodiment, PD-1 ABD comprises the variable heavy chain or the CDR1, CDR2, and CDR3 of mAb C_H1.130 and the variable light chain or the CDR1, CDR2, and CDR3 of mAb C_L1.1. the variable heavy chain or the CDR1, CDR2, and CDR3 of mAb C_H1.130 and the variable light chain or the CDR1, CDR2, and CDR3 of mAb C_L1.3. In one embodiment, PD-1 ABD comprises the variable heavy chain or the CDR1, CDR2, and CDR3 of mAb C_H1.130 and the variable light chain or the CDR1, CDR2, and CDR3 of mAb C_L1.45. In one embodiment, PD-1 ABD comprises the variable heavy chain or the CDR1, CDR2, and CDR3 of mAb C_H1.130 and the variable light chain or the CDR1, CDR2, and CDR3 of mAb C_L1.117. In one embodiment, PD-1 ABD comprises the variable heavy chain or the CDR1, CDR2, and CDR3 of mAb C_H1.130 and the variable light chain or the CDR1, CDR2, and CDR3 of mAb C_L1.129. In one embodiment, PD-1 ABD comprises the variable heavy chain or the CDR1, CDR2, and CDR3 of mAb C_H1.130 and the variable light chain or the CDR1, CDR2, and CDR3 of mAb C_L1.135. In one embodiment, PD-1 ABD comprises the variable heavy chain or the CDR1, CDR2, and CDR3 of mAb C_H1.130 and the variable light chain or the CDR1, CDR2, and CDR3 of mAb C_L1.136. In one embodiment, PD-1 ABD comprises the variable heavy chain or the CDR1, CDR2, and CDR3 of mAb C_H1.130 and the variable light chain or the CDR1, CDR2, and CDR3 of mAb C_L1.140. In one embodiment, PD-1 ABD comprises the variable heavy chain or the CDR1, CDR2, and CDR3 of mAb C_H1.130 and the variable light chain or the CDR1, CDR2, and CDR3 of mAb C_L2.

In one embodiment, PD-1 ABD comprises the variable heavy chain or the CDR1, CDR2, and CDR3 of mAb C_H1.132 and the variable light chain or the CDR1, CDR2, and CDR3 of mAb C_L1. In one embodiment, PD-1 ABD comprises the variable heavy chain or the CDR1, CDR2, and CDR3 of mAb C_H1.132 and the variable light chain or the CDR1, CDR2, and CDR3 of mAb C_L1.1. the variable heavy chain or the CDR1, CDR2, and CDR3 of mAb C_H1.132 and the variable light chain or the CDR1, CDR2, and CDR3 of mAb C_L1.3. In one embodiment, PD-1 ABD comprises the variable heavy chain or the CDR1, CDR2, and CDR3 of mAb C_H1.132 and the variable light chain or the CDR1, CDR2, and CDR3 of mAb C_L1.45. In one embodiment, PD-1 ABD comprises the variable heavy chain or the CDR1, CDR2, and CDR3 of mAb C_H1.132 and the variable light chain or the CDR1, CDR2, and CDR3 of mAb C_L1.117. In one embodiment, PD-1 ABD comprises the variable heavy chain or the CDR1, CDR2, and CDR3 of mAb C_H1.132 and the variable light chain or the CDR1, CDR2, and CDR3 of mAb C_L1.129. In one embodiment, PD-1 ABD comprises the variable heavy chain or the CDR1, CDR2, and CDR3 of mAb C_H1.132 and the variable light chain or the CDR1, CDR2, and CDR3 of mAb C_L1.135. In one embodiment, PD-1 ABD comprises the variable heavy chain or the CDR1, CDR2, and CDR3 of mAb C_H1.132 and the variable light chain or the CDR1, CDR2, and CDR3 of mAb C_L1.136. In one embodiment, PD-1 ABD comprises the variable heavy chain or the CDR1, CDR2, and CDR3 of mAb C_H1.132 and the variable light chain or the CDR1, CDR2, and CDR3 of mAb C_L1.140. In one embodiment, PD-1 ABD comprises the variable heavy chain or the CDR1, CDR2, and CDR3 of mAb C_H1.132 and the variable light chain or the CDR1, CDR2, and CDR3 of mAb C_L2.

In one embodiment, PD-1 ABD comprises the variable heavy chain or the CDR1, CDR2, and CDR3 of mAb C_H1.169 and the variable light chain or the CDR1, CDR2, and CDR3 of mAb C_L1. In one embodiment, PD-1 ABD comprises the variable heavy chain or the CDR1, CDR2, and CDR3 of mAb C_H1.169 and the variable light chain or the CDR1, CDR2, and CDR3 of mAb C_L1.1. the variable heavy chain or the CDR1, CDR2, and CDR3 of mAb C_H1.169 and the variable light chain or the CDR1, CDR2, and CDR3 of mAb C_L1.3. In one embodiment, PD-1 ABD comprises the variable heavy chain or the CDR1, CDR2, and CDR3 of mAb C_H1.169 and the variable light chain or the CDR1, CDR2, and CDR3 of mAb C_L1.45. In one embodiment, PD-1 ABD comprises the variable heavy chain or the CDR1, CDR2, and CDR3 of mAb C_H1.169 and the variable light chain or the CDR1, CDR2, and CDR3 of mAb C_L1.117. In one embodiment, PD-1 ABD comprises the variable heavy chain or the CDR1, CDR2, and CDR3 of mAb C_H1.169 and the variable light chain or the CDR1, CDR2, and CDR3 of mAb C_L1.129. In one embodiment, PD-1 ABD comprises the variable heavy chain or the CDR1, CDR2, and CDR3 of mAb C_H1.169 and the variable light chain or the CDR1, CDR2, and CDR3 of mAb C_L1.135. In one embodiment, PD-1 ABD comprises the variable heavy chain or the CDR1, CDR2, and CDR3 of mAb C_H1.169 and the variable light chain or the CDR1, CDR2, and CDR3 of mAb C_L1.136. In one embodiment, PD-1 ABD comprises the variable heavy chain or the CDR1, CDR2, and CDR3 of mAb C_H1.169 and the variable light chain or the CDR1, CDR2, and CDR3 of mAb C_L1.140. In one embodiment, PD-1 ABD comprises the variable heavy chain or the CDR1, CDR2, and CDR3 of mAb C_H1.169 and the variable light chain or the CDR1, CDR2, and CDR3 of mAb C_L2.

In one embodiment, PD-1 ABD comprises the variable heavy chain or the CDR1, CDR2, and CDR3 of mAb C_H1.175 and the variable light chain or the CDR1, CDR2, and CDR3 of mAb C_L1. In one embodiment, PD-1 ABD comprises the variable heavy chain or the CDR1, CDR2, and CDR3 of mAb C_H1.175 and the variable light chain or the CDR1, CDR2, and CDR3 of mAb C_L1.1. the variable heavy chain or the CDR1, CDR2, and CDR3 of mAb C_H1.175 and the variable light chain or the CDR1, CDR2, and CDR3 of mAb C_L1.3. In one embodiment, PD-1 ABD comprises the variable heavy chain or the CDR1, CDR2, and CDR3 of mAb C_H1.175 and the variable light chain or the CDR1, CDR2, and CDR3 of mAb C_L1.45. In one embodiment, PD-1 ABD comprises the variable heavy chain or the CDR1, CDR2, and CDR3 of mAb C_H1.175 and the variable light chain or the CDR1, CDR2, and CDR3 of mAb C_L1.117. In one embodiment, PD-1 ABD comprises the variable heavy chain or the CDR1, CDR2, and CDR3 of mAb C_H1.175 and the variable light chain or the CDR1, CDR2, and CDR3 of mAb C_L1.129. In one embodiment, PD-1 ABD comprises the variable heavy chain or the CDR1, CDR2, and CDR3 of mAb C_H1.175 and the variable light chain or the CDR1, CDR2, and CDR3 of mAb C_L1.135. In one embodiment, PD-1 ABD comprises the variable heavy chain or the CDR1, CDR2, and CDR3 of mAb C_H1.175 and the variable light chain or the CDR1, CDR2, and CDR3 of mAb C_L1.136. In one embodiment, PD-1 ABD comprises the variable heavy chain or the CDR1, CDR2, and CDR3 of mAb C_H1.175 and the variable light chain or the CDR1, CDR2, and CDR3 of mAb C_L1.140. In one embodiment, PD-1 ABD comprises the variable heavy chain or the CDR1, CDR2, and CDR3 of mAb C_H1.175 and the variable light chain or the CDR1, CDR2, and CDR3 of mAb C_L2.

In one embodiment, PD-1 ABD comprises the variable heavy chain or the CDR1, CDR2, and CDR3 of mAb C_H2 and the variable light chain or the CDR1, CDR2, and CDR3 of mAb C_L1. In one embodiment, PD-1 ABD comprises the variable heavy chain or the CDR1, CDR2, and CDR3 of mAb C_H2 and the variable light chain or the CDR1, CDR2, and CDR3 of mAb C_L1.1. the variable heavy chain or the CDR1, CDR2, and CDR3 of mAb C_H2 and the variable light chain or the CDR1, CDR2, and CDR3 of mAb C_L1.3. In one embodiment, PD-1 ABD comprises the variable heavy chain or the CDR1, CDR2, and CDR3 of mAb C_H2 and the variable light chain or the CDR1, CDR2, and CDR3 of mAb C_L1.45. In one embodiment, PD-1 ABD comprises the variable heavy chain or the CDR1, CDR2, and CDR3 of mAb C_H2 and the variable light chain or the CDR1, CDR2, and CDR3 of mAb C_L1.117. In one embodiment, PD-1 ABD comprises the variable heavy chain or the CDR1, CDR2, and CDR3 of mAb C_H2 and the variable light chain or the CDR1, CDR2, and CDR3 of mAb C_L1.129. In one embodiment, PD-1 ABD comprises the variable heavy chain or the CDR1, CDR2, and CDR3 of mAb C_H2 and the variable light chain or the CDR1, CDR2, and CDR3 of mAb C_L1.135. In one embodiment, PD-1 ABD comprises the variable heavy chain or the CDR1, CDR2, and CDR3 of mAb C_H2 and the variable light chain or the CDR1, CDR2, and CDR3 of mAb C_L1.136. In one embodiment, PD-1 ABD comprises the variable heavy chain or the CDR1, CDR2, and CDR3 of mAb C_H2 and the variable light chain or the CDR1, CDR2, and CDR3 of mAb C_L1.140. In one embodiment, PD-1 ABD comprises the variable heavy chain or the CDR1, CDR2, and CDR3 of mAb C_H2 and the variable light chain or the CDR1, CDR2, and CDR3 of mAb C_L2.

Amino acid sequences of of variable heavy chains and variable light chains of illustrative antibody monomers human PD-L1 are provided in FIGS. 76A-76J. In some embodiments, the illustrative anti-PD-L1 antibody monomer comprises a variable heavy chain and a variable light chain of an anti-PD-L1 antibody, such as, but is not limited to, YW243.55.S70 (also referred to as MPDL3280A, clone YW243.55.S70), durvalumab, atezolizumab, 12A4, 3G10, 10A5, h3D10 Var 1, h3D10 Var 2, h3D10 Var 3, h3D10 Var 4, h3D10 Var 5, h3D10 Var 6, h3D10 Var 7, h3D10 Var 8, h3D10 Var 9, h3D10 Var 10, h3D10 Var 11, h3D10 Var 12, h3D10 Var 13, h3D10 Var 14, Antibody A, C5H9v2, humanized 29E.2A3, 1B9, 4H1, mAb-42, BAP058-03, BAP058-04, BAP058-06, BAP058-07, BAP058-11, BAP058-13, H6, RC5, SH1A1Q, SH1B3, SH1D1, SH1D2, SH1D12, SH1E1, SH1G9, SH1E6, SH1A2, SH1B1, H6B1L, H6A1, H6B1, H6B2, G12, RSA1, RA3, SH1E2, SH1E4, SH1B1, SH1C8, H1H9364P2, H1H9373P2, H1H8314N, and PDL1.

In addition, the antibodies of the invention include those that bind to either the same epitope as the antigen binding domains outlined herein, or compete for binding with the antigen binding domains outlined herein. Binding competition is generally determined using Biacore assays as outlined herein.

A. Antibodies

As is discussed below, the term "antibody" is used generally. Antibodies that find use in the present invention can take on a number of formats as described herein, including traditional antibodies as well as antibody derivatives, fragments and mimetics, described herein and depicted in the figures.

The present invention provides antibody fusion proteins containing a checkpoint antigen binding domain and an Fc domain. In some embodiments, the antibody fusion protein forms a heterodimeric protein with an IL-12 Fc fusion protein described herein. In other embodiments, the antibody fusion protein forms a heterodimeric protein with another antibody fusion protein comprising a checkpoint antigen binding domain and an Fc domain. Exemplary embodiments include, but are not limited to PD-1 targeted IL-12-Fc fusion proteins, PD-L1 targeted IL-12-Fc fusion proteins, and PD-1 targeted IL-12-Fc fusion proteins that do not compete with an PD-1 blockage antibody.

Traditional antibody structural units typically comprise a tetramer. Each tetramer is typically composed of two identical pairs of polypeptide chains, each pair having one "light" (typically having a molecular weight of about 25 kDa) and one "heavy" chain (typically having a molecular weight of about 50-70 kDa). Human light chains are classified as kappa and lambda light chains. The present invention is directed to antibodies or antibody fragments (antibody monomers) that generally are based on the IgG class, which has several subclasses, including, but not limited to IgG1, IgG2, IgG3, and IgG4. In general, IgG1, IgG2 and IgG4 are used more frequently than IgG3. It should be noted that IgG1 has different allotypes with polymorphisms at 356 (D or E) and 358 (L or M). The sequences depicted herein use the 356D/358M allotype, however the other allotype is included herein. That is, any sequence inclusive of an IgG1 Fc domain included herein can have 356E/358L replacing the 356D/358M allotype.

In addition, many of the sequences herein have at least one the cysteines at position 220 replaced by a serine; generally this is the on the "scFv monomer" side for most of the sequences depicted herein, although it can also be on the "Fab monomer" side, or both, to reduce disulfide formation. Specifically included within the sequences herein are one or both of these cysteines replaced (C220S).

Thus, "isotype" as used herein is meant any of the subclasses of immunoglobulins defined by the chemical and antigenic characteristics of their constant regions. It should be understood that therapeutic antibodies can also comprise hybrids of isotypes and/or subclasses. For example, as shown in US Publ. Appl. No. 2009/0163699, incorporated by reference, the present invention covers pI engineering of IgG1/G2 hybrids.

The amino-terminal portion of each chain includes a variable region of about 100 to 110 or more amino acids primarily responsible for antigen recognition, generally referred to in the art and herein as the "Fv domain" or "Fv region". In the variable region, three loops are gathered for each of the V domains of the heavy chain and light chain to form an antigen-binding site. Each of the loops is referred to as a complementarity-determining region (hereinafter referred to as a "CDR"), in which the variation in the amino acid sequence is most significant. "Variable" refers to the fact that certain segments of the variable region differ extensively in sequence among antibodies. Variability within the variable region is not evenly distributed. Instead, the V regions consist of relatively invariant stretches called framework regions (FRs) of 15-30 amino acids separated by shorter regions of extreme variability called "hypervariable regions" that are each 9-15 amino acids long or longer.

Each VH and VL is composed of three hypervariable regions ("complementary determining regions," "CDRs") and four FRs, arranged from amino-terminus to carboxy-terminus in the following order: FR1-CDR1-FR2-CDR2-FR3-CDR3-FR4.

The hypervariable region generally encompasses amino acid residues from about amino acid residues 24-34 (LCDR1; "L" denotes light chain), 50-56 (LCDR2) and 89-97 (LCDR3) in the light chain variable region and around about 31-35B (HCDR1; "H" denotes heavy chain), 50-65 (HCDR2), and 95-102 (HCDR3) in the heavy chain variable region; Kabat et al., SEQUENCES OF PROTEINS OF IMMUNOLOGICAL INTEREST, 5th Ed. Public Health Service, National Institutes of Health, Bethesda, Md. (1991) and/or those residues forming a hypervariable loop (e.g. residues 26-32 (LCDR1), 50-52 (LCDR2) and 91-96 (LCDR3) in the light chain variable region and 26-32 (HCDR1), 53-55 (HCDR2) and 96-101 (HCDR3) in the heavy chain variable region; Chothia and Lesk (1987) J. Mol. Biol. 196:901-917. Specific CDRs of the invention are described below.

As will be appreciated by those in the art, the exact numbering and placement of the CDRs can be different among different numbering systems. However, it should be understood that the disclosure of a variable heavy and/or variable light sequence includes the disclosure of the associated (inherent) CDRs. Accordingly, the disclosure of each variable heavy region is a disclosure of the vhCDRs (e.g. vhCDR1, vhCDR2 and vhCDR3) and the disclosure of each variable light region is a disclosure of the vhCDRs (e.g. vlCDR1, vlCDR2 and vlCDR3).

A useful comparison of CDR numbering is as below, see Lafranc et al., Dev. Comp. Immunol. 27(1):55-77 (2003):

TABLE 1

|  | Kabat + Chothia | IMGT | Kabat | AbM | Chothia | Contact | Xencor |
|---|---|---|---|---|---|---|---|
| vhCDR1 | 26-35 | 27-38 | 31-35 | 26-35 | 26-32 | 30-35 | 27-35 |
| vhCDR2 | 50-65 | 56-65 | 50-65 | 50-58 | 52-56 | 47-58 | 54-61 |
| vhCDR3 | 95-102 | 105-117 | 95-102 | 95-102 | 95-102 | 93-101 | 103-116 |
| vlCDR1 | 24-34 | 27-38 | 24-34 | 24-34 | 24-34 | 30-36 | 27-38 |
| vlCDR2 | 50-56 | 56-65 | 50-56 | 50-56 | 50-56 | 46-55 | 56-62 |
| vlCDR3 | 89-97 | 105-117 | 89-97 | 89-97 | 89-97 | 89-96 | 97-105 |

Throughout the present specification, the Kabat numbering system is generally used when referring to a residue in the variable domain (approximately, residues 1-107 of the light chain variable region and residues 1-113 of the heavy chain variable region) and the EU numbering system for Fc regions (e.g, Kabat et al., supra (1991)).

The present invention provides a large number of different CDR sets. In this case, a "full CDR set" comprises the three variable light and three variable heavy CDRs, e.g. a vlCDR1, vlCDR2, vlCDR3, vhCDR1, vhCDR2 and vhCDR3. These can be part of a larger variable light or variable heavy domain, respectfully. In addition, as more fully outlined herein, the variable heavy and variable light domains can be on separate polypeptide chains, when a heavy and light chain is used (for example when Fabs are used), or on a single polypeptide chain in the case of scFv sequences.

The CDRs contribute to the formation of the antigen-binding, or more specifically, epitope binding site of antibodies. "Epitope" refers to a determinant that interacts with a specific antigen binding site in the variable region of an antibody molecule known as a paratope. Epitopes are groupings of molecules such as amino acids or sugar side chains and usually have specific structural characteristics, as well as specific charge characteristics. A single antigen may have more than one epitope.

The epitope may comprise amino acid residues directly involved in the binding (also called immunodominant component of the epitope) and other amino acid residues, which are not directly involved in the binding, such as amino acid residues which are effectively blocked by the specifically antigen binding peptide; in other words, the amino acid residue is within the footprint of the specifically antigen binding peptide.

Epitopes may be either conformational or linear. A conformational epitope is produced by spatially juxtaposed amino acids from different segments of the linear polypeptide chain. A linear epitope is one produced by adjacent amino acid residues in a polypeptide chain. Conformational and nonconformational epitopes may be distinguished in that the binding to the former but not the latter is lost in the presence of denaturing solvents.

An epitope typically includes at least 3, and more usually, at least 5 or 8-10 amino acids in a unique spatial conformation. Antibodies that recognize the same epitope can be verified in a simple immunoassay showing the ability of one antibody to block the binding of another antibody to a target antigen, for example "binning." As outlined below, the invention not only includes the enumerated antigen binding domains and antibodies herein, but those that compete for binding with the epitopes bound by the enumerated antigen binding domains.

The carboxy-terminal portion of each chain defines a constant region primarily responsible for effector function. Kabat et al. collected numerous primary sequences of the variable regions of heavy chains and light chains. Based on the degree of conservation of the sequences, they classified individual primary sequences into the CDR and the framework and made a list thereof (see SEQUENCES OF IMMUNOLOGICAL INTEREST, 5th edition, NIH publication, No. 91-3242, E. A. Kabat et al., entirely incorporated by reference).

In the IgG subclass of immunoglobulins, there are several immunoglobulin domains in the heavy chain. By "immunoglobulin (Ig) domain" herein is meant a region of an immunoglobulin having a distinct tertiary structure. Of interest in the present invention are the heavy chain domains, including, the constant heavy (CH) domains and the hinge domains. In the context of IgG antibodies, the IgG isotypes each have three CH regions. Accordingly, "CH" domains in the context of IgG are as follows: "CH1" refers to positions 118-220 according to the EU index as in Kabat. "CH2" refers to positions 237-340 according to the EU index as in Kabat, and "CH3" refers to positions 341-447 according to the EU index as in Kabat. As shown herein and described below, the pI variants can be in one or more of the CH regions, as well as the hinge region, discussed below.

Another type of Ig domain of the heavy chain is the hinge region. By "hinge" or "hinge region" or "antibody hinge region" or "immunoglobulin hinge region" herein is meant the flexible polypeptide comprising the amino acids between the first and second constant domains of an antibody. Structurally, the IgG CH1 domain ends at EU position 220, and the IgG CH2 domain begins at residue EU position 237. Thus for IgG the antibody hinge is herein defined to include positions 221 (D221 in IgG1) to 236 (G236 in IgG1), wherein the numbering is according to the EU index as in Kabat. In some embodiments, for example in the context of an Fc region, the lower hinge is included, with the "lower hinge" generally referring to positions 226 or 230. As noted herein, pI variants can be made in the hinge region as well.

The light chain generally comprises two domains, the variable light domain (containing the light chain CDRs and together with the variable heavy domains forming the FAT region), and a constant light chain region (often referred to as CL or Cx).

Another region of interest for additional substitutions, outlined above, is the Fc region.

Thus, the present invention provides different antibody domains. As described herein and known in the art, the heterodimeric antibodies of the invention comprise different domains within the heavy and light chains, which can be overlapping as well. These domains include, but are not limited to, the Fc domain, the CH1 domain, the CH2 domain, the CH3 domain, the hinge domain, the heavy constant domain (CH1-hinge-Fc domain or CH1-hinge-CH2-CH3), the variable heavy domain, the variable light domain, the light constant domain, Fab domains and scFv domains.

Thus, the "Fc domain" includes the -CH2-CH3 domain, and optionally a hinge domain. In the embodiments herein, when a scFv is attached to an Fc domain, it is the C-terminus of the scFv construct that is attached to all or part of the hinge of the Fc domain; for example, it is generally attached to the sequence EPKS (SEQ ID NO: 833) which is the beginning of the hinge. The heavy chain comprises a variable heavy domain and a constant domain, which includes a CH1-optional hinge-Fc domain comprising a CH2-CH3. The light chain comprises a variable light chain and the light constant domain. A scFv comprises a variable heavy chain, an scFv linker, and a variable light domain. In most of the constructs and sequences outlined herein, C-terminus of the variable light chain is attached to the N-terminus of the scFv linker, the C-terminus of which is attached to the N-terminus of a variable heavy chain (N-vh-linker-vl-C) although that can be switched (N-vl-linker-vh-C).

Some embodiments of the invention comprise at least one scFv domain, which, while not naturally occurring, generally includes a variable heavy domain and a variable light domain, linked together by a scFv linker. As outlined herein, while the scFv domain is generally from N- to C-terminus oriented as vh-scFv linker-vl, this can be reversed for any of the scFv domains (or those constructed using vh and vl sequences from Fabs), to vl-scFv linker-vh, with optional linkers at one or both ends depending on the format (see generally FIGS. 4A-4B of U.S. 62/353,511).

As shown herein, there are a number of suitable scFv linkers that can be used, including traditional peptide bonds, generated by recombinant techniques. The linker peptide may predominantly include the following amino acid residues: Gly, Ser, Ala, or Thr. The linker peptide should have a length that is adequate to link two molecules in such a way that they assume the correct conformation relative to one another so that they retain the desired activity. In one embodiment, the linker is from about 1 to 50 amino acids in length, preferably about 1 to 30 amino acids in length. In one embodiment, linkers of 1 to 20 amino acids in length may be used, with from about 5 to about 10 amino acids finding use in some embodiments. Useful linkers include glycine-serine polymers, including for example (GS)n, (GSGGS)n (SEQ ID NO: 838), (GGGGS)n (SEQ ID NO: 9), and (GGGS)n (SEQ ID NO: 840), where n is an integer of at least one (and generally from 3 to 4), glycine-alanine polymers, alanine-serine polymers, and other flexible linkers. Alternatively, a variety of nonproteinaceous polymers, including but not limited to polyethylene glycol (PEG), polypropylene glycol, polyoxyalkylenes, or copolymers of polyethylene glycol and polypropylene glycol, may find use as linkers, that is may find use as linkers.

Other linker sequences may include any sequence of any length of CL/CH1 domain but not all residues of CL/CH1 domain; for example the first 5-12 amino acid residues of the CL/CH1 domains. Linkers can be derived from immunoglobulin light chain, for example CK or CX. Linkers can be derived from immunoglobulin heavy chains of any isotype, including for example Cγ1, Cγ2, Cγ3, Cγ4, Cα1, Cα2, Cδ, Cε, and Cμ. Linker sequences may also be derived from other proteins such as Ig-like proteins (e.g., TCR, FcR, KIR), hinge region-derived sequences, and other natural sequences from other proteins.

In some embodiments, the scFv linker is a charged scFv linker, a number of which are shown in FIG. 4A of U.S. 62/353,511. Accordingly, the present invention further provides charged scFv linkers, to facilitate the separation in pI between a first and a second monomer (e.g., an IL-12 (p35/p40 or p40/p35)) monomer and PD-1 ABD monomer). That is, by incorporating a charged scFv linker, either positive or negative (or both, in the case of scaffolds that use scFvs on different monomers), this allows the monomer comprising the charged linker to alter the pI without making further changes in the Fc domains. These charged linkers can be substituted into any scFv containing standard linkers. Again, as will be appreciated by those in the art, charged scFv linkers are used on the correct "strand" or monomer, according to the desired changes in pI. For example, as discussed herein, to make triple F format heterodimeric antibody, the original pI of the Fv region for each of the desired antigen binding domains are calculated, and one is chosen to make an scFv, and depending on the pI, either positive or negative linkers are chosen.

Charged domain linkers can also be used to increase the pI separation of the monomers of the invention as well, and thus those included in FIG. 10 can be used in any embodiment herein where a linker is utilized.

In one embodiment, the antibody is an antibody fragment, as long as it contains at least one constant domain which can be engineered to produce heterodimers, such as pI engineering. Other antibody fragments that can be used include fragments that contain one or more of the CH1, CH2, CH3, hinge and CL domains of the invention that have been pI engineered. In particular, the formats depicted in FIGS. 34A-34H are Fc fusion proteins, referred to as "heterodimeric Fc fusion protein" or "bifunctional heterodimeric Fc fusion protein" or "heterodimeric fusion proteins", meaning that the protein has at least two associated Fc sequences self-assembled into a heterodimeric Fc domain and at least one Fv regions, whether as Fabs or as scFvs.

B. Chimeric and Humanized Antibodies

In some embodiments, the antibodies herein can be derived from a mixture from different species, e.g., a chimeric antibody and/or a humanized antibody. In general, both "chimeric antibodies" and "humanized antibodies" refer to antibodies that combine regions from more than one species. For example, "chimeric antibodies" traditionally comprise variable region(s) from a mouse (or rat, in some cases) and the constant region(s) from a human. "Humanized antibodies" generally refer to non-human antibodies that have had the variable-domain framework regions swapped for sequences found in human antibodies. Generally, in a humanized antibody, the entire antibody, except the CDRs, is encoded by a polynucleotide of human origin or is identical to such an antibody except within its CDRs. The CDRs, some or all of which are encoded by nucleic acids originating in a non-human organism, are grafted into the beta-sheet framework of a human antibody variable region to create an antibody, the specificity of which is determined by the engrafted CDRs. The creation of such antibodies is described in, e.g., WO 92/11018, Jones, 1986, Nature 321: 522-525, Verhoeyen et al., 1988, Science 239:1534-1536, all entirely incorporated by reference. "Backmutation" of selected acceptor framework residues to the corresponding donor residues is often required to regain affinity that is lost in the initial grafted construct (U.S. Pat. Nos. 5,530,101; 5,585,089; 5,693,761; 5,693,762; 6,180,370; 5,859,205; 5,821,337; 6,054,297; 6,407,213, all entirely incorporated by reference). The humanized antibody optimally also will comprise at least a portion of an immunoglobulin constant region, typically that of a human immunoglobulin, and thus will typically comprise a human Fc region Humanized antibodies can also be generated using mice with a genetically engineered immune system. Roque et al., 2004, Biotechnol. Prog. 20:639-654, entirely incorporated by reference. A variety of techniques and methods for humanizing and reshaping non-human antibodies are well known in the art (See Tsurushita & Vasquez, 2004, Humanization of Monoclonal Antibodies, Molecular Biology of B Cells, 533-545, Elsevier Science (USA), and references cited therein, all entirely incorporated by reference). Humanization methods include but are not limited to methods described in Jones et al., 1986, Nature 321:522-525; Riechmann et al., 1988; Nature 332:323-329; Verhoeyen et al., 1988, Science, 239:1534-1536; Queen et al., 1989, Proc Natl Acad Sci, USA 86:10029-33; He et al., 1998, J. Immunol. 160: 1029-1035; Carter et al., 1992, Proc Natl Acad Sci USA 89:4285-9, Presta et al., 1997, Cancer Res. 57(20):4593-9; Gorman et al., 1991, Proc. Natl. Acad. Sci. USA 88:4181-4185; O'Connor et al., 1998, Protein Eng 11:321-8, all entirely incorporated by reference. Humanization or other methods of reducing the immunogenicity of nonhuman antibody variable regions may include resurfacing methods, as described for example in Roguska et al., 1994, Proc. Natl. Acad. Sci. USA 91:969-973, entirely incorporated by reference. In certain embodiments, the antibodies of the invention comprise a heavy chain variable region from a particular germline heavy chain immunoglobulin gene and/or a light chain variable region from a particular germline light chain immunoglobulin gene. For example, such antibodies may comprise or consist of a human antibody comprising heavy or light chain variable regions that are "the product of" or "derived from" a particular germline sequence. A human antibody that is "the product of" or "derived from" a human germline immunoglobulin sequence can be identified as such by comparing the amino acid sequence of the human antibody to the amino acid sequences of human germline immunoglobulins and selecting the human germline immunoglobulin sequence that is closest in sequence (i.e., greatest % identity) to the sequence of the human antibody. A human antibody that is "the product of" or "derived from" a particular human germline immunoglobulin sequence may contain amino acid differences as compared to the germline sequence, due to, for example, naturally-occurring somatic mutations or intentional introduction of site-directed mutation. However, a humanized antibody typically is at least 90% identical in amino acids sequence to an amino acid sequence encoded by a human germline immunoglobulin gene and contains amino acid residues that identify the antibody as being derived from human sequences when compared to the germline immunoglobulin amino acid sequences of other species (e.g., murine germline sequences). In certain cases, a humanized antibody may be at least 95, 96, 97, 98 or 99%, or even at least 96%, 97%, 98%, or 99% identical in amino acid sequence to the amino acid sequence encoded by the germline immunoglobulin gene. Typically, a humanized antibody derived from a particular human germline sequence will display no more than 10-20 amino acid differences from the amino acid sequence encoded by the human germline immunoglobulin gene (prior to the introduction of any skew, pI and ablation variants herein; that is, the number of variants is generally low, prior to the introduction of the variants of the invention). In certain cases, the humanized antibody may display no more than 5, or even no more than 4, 3, 2, or 1 amino acid difference from the amino acid sequence encoded by the germline immunoglobulin gene (again, prior to the introduction of any skew, pI and ablation variants herein; that is, the number of variants is generally low, prior to the introduction of the variants of the invention). In one embodiment, the parent antibody has been affinity matured, as is known in the art. Structure-based methods may be employed for humanization and affinity maturation, for example as described in U.S. Ser. No. 11/004,590. Selection based methods may be employed to humanize and/or affinity mature antibody variable regions, including but not limited to methods described in Wu et al., 1999, J. Mol. Biol. 294:151-162; Baca et al., 1997, J. Biol. Chem. 272(16):10678-10684; Rosok et al., 1996, J. Biol. Chem. 271(37): 22611-22618; Rader et al., 1998, Proc. Natl. Acad. Sci. USA 95: 8910-8915; Krauss et al., 2003, Protein Engineering 16(10):753-759, all entirely incorporated by reference. Other humanization methods may involve the grafting of only parts of the CDRs, including but not limited to methods described in U.S. Ser. No. 09/810,510; Tan et al., 2002, J. Immunol. 169:1119-1125; De Pascalis et al., 2002, J. Immunol. 169:3076-3084, all entirely incorporated by reference.

VII. Useful Formats of the Invention

As shown in FIGS. 79A-79E there are a number of useful formats of the heterodimeric fusion proteins of the invention. In general, the heterodimeric fusion proteins of the invention have three functional components: an antigen binding domain, an IL-12 heterodimer component and an Fc component, both of which can take different forms as outlined herein and both of which can be combined with the other component in any configuration.

In some embodiments, the IL-12p35 and IL-12p40 subunits are covalently linked, optionally with a domain linker, and is referred to herein as a single-chain IL-12 complex or "scIL-12". The scIL-12 can comprise either IL-12p35 N-terminally linked to IL-12p40 or IL-12p40 N-terminally linked to IL-12p35, optionally with a domain linker. The order of the two subunits in the scIL-12 may be designated as follows: "scIL-12(p40/p35)", wherein the IL-12p40 subunit is N-terminally linked (with or without a domain linker) to the IL-12p35 subunit, or "scIL-12(p35/p40)", wherein the IL-12p35 subunit is N-terminally linked (with or without a domain linker) to the IL-12p40 subunit.

In some embodiments, the IL-12p35 and IL-12p40 subunits are not covalently linked, but rather are covalently attached respectively to a first and a second Fc domain which are assembled as a heterodimer.

The first and the second Fc domains can have a set of amino acid substitutions selected from the group consisting of a) L368D/K370S and S364K; b) L368D/K370S and S364K/E357L; c) L368D/K370S and S364K/E357Q; d) S267K/L368D/K370S and S267K/S364K/E357Q; e)

T411E/K360E/Q362E and D401K; f) L368E/K370S and S364K; g) K370S and S364K/E357Q; and h) T366S/L368A/Y407V and T366W (optionally including a bridging disulfide, T366S/L368A/Y407V/Y349C and T366W/S354C), according to EU numbering.

In some embodiments, the first and/or the second Fc domains have an additional set of amino acid substitutions comprising Q295E/N384D/Q418E/N421D, according to EU numbering.

Optionally, the first and/or the second Fc domains have an additional set of amino acid substitutions selected from the group consisting of G236R/L328R, E233P/L234V/L235A/G236del/S239K, E233P/L234V/L235A/G236del/S239K/A327G, E233P/L234V/L235A/G236del/S267K/A327G, E233P/L234V/L235A/G236del, and E233P/L234V/L235A/G236del/S267K, according to EU numbering. In some embodiments, the first Fc domain have an additional set of amino acid substitutions selected from the group consisting of G236R/L328R, E233P/L234V/L235A/G236del/S239K, E233P/L234V/L235A/G236del/S239K/A327G, E233P/L234V/L235A/G236del/S267K/A327G, E233P/L234V/L235A/G236del, and E233P/L234V/L235A/G236del/S267K, according to EU numbering. In some embodiments, the second Fc domain have an additional set of amino acid substitutions selected from the group consisting of G236R/L328R, E233P/L234V/L235A/G236del/S239K, E233P/L234V/L235A/G236del/S239K/A327G, E233P/L234V/L235A/G236del/S267K/A327G, E233P/L234V/L235A/G236del, and E233P/L234V/L235A/G236del/S267K, according to EU numbering. In certain embodiments, the the first Fc domain and second Fc domain each have an additional set of amino acid substitutions selected from the group consisting of G236R/L328R, E233P/L234V/L235A/G236del/S239K, E233P/L234V/L235A/G236del/S239K/A327G, E233P/L234V/L235A/G236del/S267K/A327G, E233P/L234V/L235A/G236del, and E233P/L234V/L235A/G236del/S267K, according to EU numbering.

Optionally, the first and/or second Fc domains have M428L/N434S variants for half life extension. In some embodiments, the first and second Fc domains each have M428L/N434S substitutions. In some embodiments, the first Fc domain has M428L/N434S substitutions. In some embodiments, the second Fc domain has M428L/N434S substitutions.

A. Targeted scFv x scIL-12-Fc Format

Figure 79A:
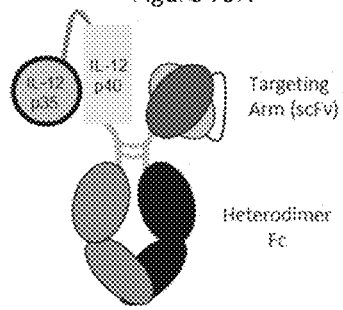

In some embodiments, the present invention provides the targeted N-terminal single-chain (sc) IL-12-Fc fusion or "targeted scFv x scIL-12-Fc" or "scIL-12-Fc x targeted scFv" format. In this embodiment, as shown in FIG. 79A, the heterodimeric fusion protein comprises two monomers. The first monomer comprises (from N-to-C-terminus) scIL-12-optional domain linker-Fc. The second monomer comprises an scFv domain that binds a target antigen (also referred to as a targeting arm). The targeted scIL-12 may be a "targeted scIL-12(p40/p35)", wherein the IL-12p40 subunit is N-terminally linked (with or without a domain linker) to the IL-12p35 subunit, or "targeted scFv x scIL-12(p35/p40)", wherein the IL-12p35 is N-terminally linked (with or without a domain linker) to the IL-12p40 subunit.

In other words, the "scIL-12×scFv" format (see, e.g., FIG. 79A) comprises human IL-12p40 fused (optionally by a variable length linker) to human IL-12p35 (termed scIL-12) which is fused (optionally by a variable length linker) to the N-terminus of a heterodimeric Fc-region, with an scFv fused to the other side of the heterodimeric Fc. It should be noted that in this format, the position of the IL-12p40 subunit and IL-12p35 subunit can be swapped.

In some embodiments, the targeted IL-12 heterodimeric Fc fusion protein comprises: (a) a fusion protein comprising a first protein domain, a second protein domain and a first variant Fc domain, wherein the first protein domain is covalently attached to the second protein domain, and wherein the second protein domain is covalently attached to the N-terminus of the first Fc domain; and (b) a second fusion protein second monomer comprises an scFv domain that binds a target antigen (also referred to as a targeting arm) such as human PD-1 or human PD-L1. The scFv domain comprises a second variant Fc domain. The first and second variant Fc domains comprise modifications promoting heterodimerization of the first and second Fc domains. In some instances, the first protein domain comprises an IL-12p40 subunit (or a variant IL-12p40 subunit) and the second protein domain comprises an IL-12p35 subunit (or a variant IL-12p35 subunit). In other instances, the first protein domain comprises an IL-12p35 subunit (or a variant IL-12p35 subunit) and the second protein domain comprises an IL-12p40 subunit (or a variant IL-12p40 subunit).

In this format, useful Fc variants include, but are not limited to, skew variants, pI variants, isosteric variants, FcγR variants, ablation variants, and any combination thereof, as for example, described herein. In the targeted scFv x scIL-12-Fc format, a preferred embodiment utilizes the skew variant pair S364K/E357Q and L368D/K370S. In some embodiments, the first variant Fc domain includes the skew variant S364K/E357Q and the second variant Fc domain includes the skew variant L368D/K370S. In some embodiments, the first variant Fc domain includes the skew variant L368D/K370S and the second variant Fc domain includes the skew variant S364K/E357Q.

In some embodiments, the scFv domain binds human PD-1. Amino acid sequences of an illustrative anti-PD-1 scFv include a variable heavy chain (VH) domain and a variable light chain (VL) domain thereof that competes for PD-1 binding with nivolumab and/or pembrolizumab are provided in FIGS. 70A-70G and the corresponding sequence listing. An exemplary anti-PD-1 scFv, such as a competing anti-PD-1 scFv includes, but is not limited to, 1C11[PD-1], pembrolizumab, nivolizumab, pidilizumab, MK-3475[PD-1], BAP049 clone E[PD-1], BAP049 clone B[PD-1], H7709N [PD-1], H7798N [PD-1], h1H3 Var 6[PD-1], APE2058[PD-1], H005-1 [PD-1], 317-4B6 [PD-1], 326-4A3 [PD-1], hPD-1 mAb 7 [PD-1], Clone 38 [PD-1], Clone 39 [PD-1], Clone 41 [PD-1], Clone 48 [PD-1], PD1-17 [PD-1], PD1-28 [PD-1], PD1-33 [PD-1], PD1-35 [PD-1], LOPD180 [PD-1], Ab948 [PD-1], humanized EH-12.2H7 [PD-1], RG1H10 [PD-1], RG1H10-H2A-22-1S [PD-1], RG1H10-H2A-27-2S [PD-1], RG1H10-3C [PD-1], RG1H10-16C [PD-1], RG1H10-17C [PD-1], RG1H10-19C [PD-1], RG1H10-21C [PD-1], RG1H10-23C2 [PD-1], mAB7 [PD-1], and PD1AB-6 [PD-1], as provided in FIGS. 70A-70G.

In certain embodiments, the scFv domain binds human PD-1 and does not compete for human PD-1 with nivolumab and/or pembrolizumab. In some instances, the scFv binds a different epitope than nivolumab. In some instances, the scFv binds a different epitope than pembrolizumab. Amino acid sequences of an illustrative anti-PD-1 scFv comprising a variable heavy chain (VH) domain and a variable light chain (VL) domain that does not compete for PD-1 binding with nivolumab and/or pembrolizumab are provided in FIGS. 70G-70I and the corresponding sequence listing.

An exemplary anti-PD-1 scFv, such as a non-competing anti-PD-1 scFv utilizes sequences including, but is not limited to, those of mAb A[PD-1]_H1L1, mAb B[PD-1]_

H1L1, mAb C[PD-1]_H1L1, and mAb C[PD-1]_H1.19L10. In some embodiments, an illustrative anti-PD-1 Fab utilizes a VH domain selected from the group consisting of mAb C[PD-1]_H1, mAb C[PD-1]_H1.19, mAb C[PD-1]_ H1.48, mAb C[PD-1]_H1.125, mAb C[PD-1]_H1.130, mAb C[PD-1]_H1.132, mAb C[PD-1]_H1.169, mAb C[PD-1]_H1.175, and mAb C[PD-1]_H2; and a VL domain selected from the group consisting of mAb C[PD-1]_l1, mAb C[PD-1]_L1.1, mAb C[PD-1]_L1.3, mAb C[PD-1]_L1.45, mAb C[PD-1]_L1.117, mAb C[PD-1]_L1.129, mAb C[PD-1]_L1.135, mAb C[PD-1]_L1.136, mAb C[PD-1]_L1.140, and mAb C[PD-1]_L2, as provided in FIGS. 70G-70I and the corresponding sequence listing. Additional anti-PD-1 scFvs include sequences such as, but not limited to, those of mAb C[PD-1]_H1.1_L1 to mAb C[PD-1]_H1.168_L1 as mentioned in FIGS. 75A-75E and mAb_C[PD-1]_H1_L1.1 to mAb_C[PD-1]_H1_L1.134 as mentioned in FIGS. 75E-75I.

In some embodiments, the scFv domain binds human PD-L1. Amino acid sequences of an illustrative anti-PD-L1 scFv comprising a variable heavy chain (VH) domain and a variable light chain (VL) domain are provided in FIGS. 76A-76J and the corresponding sequence listing. In some embodiments, an illustrative anti-PD-L1 scFv utilizes a VH domain and a VL domain as represented as durvalumab, atezolizumab, 12A4, 3G10, 10A5, h3D10 Var 1, h3D10 Var 2, h3D10 Var 3, h3D10 Var 4, h3D10 Var 5, h3D10 Var 6, h3D10 Var 7, h3D10 Var 8, h3D10 Var 9, h3D10 Var 10, h3D10 Var 11, h3D10 Var 12, h3D10 Var 13, h3D10 Var 14, Antibody A, C5H9v2, humanized 29E.2A3, 1B9, 4H1, mAb-42, BAP058-03, BAP058-04, BAP058-06, BAP058-07, BAP058-11, BAP058-13, H6, RC5, SH1A1Q, SH1B3, SH1D1, SH1D2, SH1D12, SH1E1, SH1G9, SH1E6, SH1A2, SH1B1, H6B1L, H6A1, H6B1, H6B2, G12, RSA1, RA3, SH1E2, SH1E4, SH1B1, SH1C8, H1H9364P2, H1H9373P2, H1H8314N, and PDL1, as provided in FIGS. 76A-76J and the corresponding sequence listing.

In this format, useful variant IL-12p40 subunits include, but are not limited to, D18K/E59K/K99E, D18K/E59K/K99E/C252S, D18K/E59K/K99E/C252S/K264E, D18K/E59K/K99E/K264E, E32Q/D34N/E59K/K99E, E59K/K99E, E59K/K99E/C252S/K264E, and E59K/K99E/K264E, and E59K/K99Y. In some embodiments, the variant IL-12p40 of this format also include one or more glycosylation modification selected from the group consisting of N103D, N103Q, N113D, N113Q, N200D, N200Q, N281D, and N281Q.

In this format, useful variant IL-12p35 subunits include, but are not limited to, one or more substitutions selected from the group consisting of N71D, N71Q, N85D, N85Q, N195D, and N195Q.

In some embodiments, a PD-1 targeted scFv x scIL-12 heterodimeric Fc fusion protein comprises any one of the scFvs that bind PD-1 as described herein, a variant IL-12p40 subunit comprising one or more sets of amino acid substitutions selected from the group consisting of D18K/E59K/K99E, D18K/E59K/K99E/C252S, D18K/E59K/K99E/C252S/K264E, D18K/E59K/K99E/K264E, E32Q/D34N/E59K/K99E, E59K/K99E, E59K/K99E/C252S/K264E, and E59K/K99E/K264E, E59K/K99Y, N103D, N103Q, N113D, N113Q, N200D, N200Q, N281D, and N281Q; and a wildtype (unmodified) IL-12p35 subunit.

In some embodiments, a PD-L1 targeted scFv x scIL-12 heterodimeric Fc fusion protein comprises any one of the scFvs that bind PD-L1 as described herein, a variant IL-12p40 subunit comprising one or more sets of amino acid substitutions selected from the group consisting of D18K/E59K/K99E, D18K/E59K/K99E/C252S, D18K/E59K/K99E/C252S/K264E, D18K/E59K/K99E/K264E, E32Q/D34N/E59K/K99E, E59K/K99E, E59K/K99E/C252S/K264E, and E59K/K99E/K264E, E59K/K99Y, N103Q, N113D, N113Q, N200D, N200Q, N281D, and N281Q; and a wildtype (unmodified) IL-12p35 subunit.

In some embodiments, a PD-1 targeted scFv x scIL-12 heterodimeric Fc fusion protein comprises any one of the scFvs that bind PD-1 as described herein, a variant IL-12p40 subunit comprising one or more sets of amino acid substitutions selected from the group consisting of D18K/E59K/K99E, D18K/E59K/K99E/C252S, D18K/E59K/K99E/C252S/K264E, D18K/E59K/K99E/K264E, E32Q/D34N/E59K/K99E, E59K/K99E, E59K/K99E/C252S/K264E, and E59K/K99E/K264E, E59K/K99Y, N103D, N103Q, N113D, N113Q, N200D, N200Q, N281D, and N281Q; and a variant IL-12p35 subunit comprising one or more substitutions selected from the group consisting of N71D, N71Q, N85D, N85Q, N195D, and N195Q.

In some embodiments, a PD-L1 targeted scFv x scIL-12 heterodimeric Fc fusion protein comprises any one of the scFvs that bind PD-L1 as described herein, a variant IL-12p40 subunit comprising one or more sets of amino acid substitutions selected from the group consisting of D18K/E59K/K99E, D18K/E59K/K99E/C252S, D18K/E59K/K99E/C252S/K264E, D18K/E59K/K99E/K264E, E32Q/D34N/E59K/K99E, E59K/K99E, E59K/K99E/C252S/K264E, K264E, and E59K/K99E/K264E, E59K/K99Y, N103D, N103Q, N113D, N113Q, N200D, N200Q, N281D, and N281Q; and a variant IL-12p35 subunit comprising one or more substitutions selected from the group consisting of N71D, N71Q, N85D, N85Q, N195D, and N195Q.

B. Targeted Fab x scIL-12-Fc Format

Figure 79B:
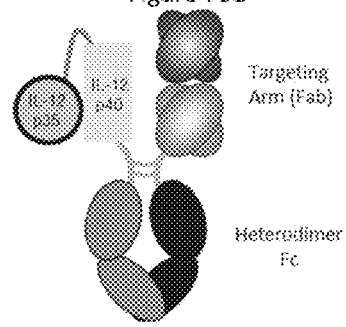

In some embodiments, the present invention provides the targeted N-terminal single-chain IL-12-Fc fusion or "targeted Fab x scIL-12-Fc" or "scIL-12-Fc x targeted Fab" format. In this embodiment, as shown in FIG. 79B, the heterodimeric fusion protein comprises three monomers. The first monomer comprises (from N-to-C-terminus) scIL-12-optional domain linker-Fc. The second monomer is a heavy chain of the antigen binding domain (also referred to as a targeting arm) comprising VH-CH1-hinge-CH2-CH3. The third domain is a light chain of the antigen binding domain comprising VL-CL. The light chain (the third monomer) is transfected separately so as to form a Fab with the VH of the second monomer and the Fab binds a target antigen.

The scIL-12 of the first monomer may be a "scIL-12(p40/p35)", wherein the IL-12p40 subunit is N-terminally linked (with or without a domain linker) to the IL-12p35 subunit, or "scIL-12(p35/p40)", wherein the IL-12p35 is N-terminally linked (with or without a domain linker) to the IL-12p40 subunit.

In other words, the "scIL-12×Fab" format (see, e.g., FIG. 79B) comprises human IL-12p40 fused (optionally by a variable length linker) to human IL-12p35 (termed scIL-12), which is fused (optionally by a variable length linker) to the N-terminus of a heterodimeric Fc-region, with a variable heavy chain (VH) fused to the other side of the heterodimeric Fc, while a corresponding light chain is transfected separately so as to form a Fab with the VH. It should be noted that in this format, the position of the IL-12p40 subunit and IL-12p35 subunit can be swapped.

In some embodiments, the targeted IL-12 heterodimeric Fc fusion protein comprises: (a) a fusion protein comprising a first protein domain, a second protein domain and a first variant Fc domain, wherein the first protein domain is covalently attached to the second protein domain, and wherein the second protein domain is covalently attached to the N-terminus of the first Fc domain; and (b) a second fusion protein second monomer comprises a Fab domain that binds a target antigen (also referred to as a targeting arm) such as human PD-1 or human PD-L1. The Fab domain comprises a second variant Fc domain. The first and second variant Fc domains comprise modifications promoting heterodimerization of the first and second Fc domains. In some instances, the first protein domain comprises an IL-12p40 subunit (or a variant IL-12p40 subunit) and the second protein domain comprises an IL-12p35 subunit (or a variant IL-12p35 subunit). In other instances, the first protein domain comprises an IL-12p35 subunit (or a variant IL-12p35 subunit) and the second protein domain comprises an IL-12p40 subunit (or a variant IL-12p40 subunit).

In this format, useful Fc variants include, but are not limited to, skew variants, pI variants, isosteric variants, FcγR variants, ablation variants, and any combination thereof, as for example, described herein. In the targeted Fab x scIL-12-Fc format, a preferred embodiment utilizes the skew variant pair S364K/E357Q and L368D/K370S. In some embodiments, the first variant Fc domain includes the skew variant S364K/E357Q and the second variant Fc domain includes the skew variant L368D/K370S. In some embodiments, the first variant Fc domain includes the skew variant L368D/K370S and the second variant Fc domain includes the skew variant S364K/E357Q.

In some embodiments, the Fab binds human PD-1. Amino acid sequences of an illustrative anti-PD-1 Fab that competes for PD-1 binding with nivolumab and/or pembrolizumab are provided in FIGS. 70A-70G and the corresponding sequence listing. An exemplary anti-PD-1 Fab, such as a competing anti-PD-1 Fab includes, but is not limited to, 1C11[PD-1], pembrolizumab, nivolizumab, pidilizumab, MK-3475[PD-1], BAP049 clone E[PD-1], BAP049 clone B[PD-1], H7709N [PD-1], H7798N [PD-1], h1H3 Var 6[PD-1], APE2058[PD-1], H005-1 [PD-1], 317-4B6 [PD-1], 326-4A3 [PD-1], hPD-1 mAb 7 [PD-1], Clone 38 [PD-1], Clone 39 [PD-1], Clone 41 [PD-1], Clone 48 [PD-1], PD1-17 [PD-1], PD1-28 [PD-1], PD1-33 [PD-1], PD1-35 [PD-1], LOPD180 [PD-1], Ab948 [PD-1], humanized EH-12.2H7 [PD-1], RG1H10 [PD-1], RG1H10-H2A-22-1S [PD-1], RG1H10-H2A-27-2S [PD-1], RG1H10-3C [PD-1], RG1H10- 16C [PD-1], RG1H10-17C [PD-1], RG1H10-19C [PD-1], RG1H10-21C [PD-1], RG1H10-23C2 [PD-1], mAB7 [PD-1].

In certain embodiments, the Fab binds human PD-1 does not compete for the human PD-1 with nivolumab and/or pembrolizumab. In some instances, the Fab binds a different epitope than nivolumab. In some instances, the Fab binds a different epitope than pembrolizumab. Amino acid sequences of an illustrative anti-PD-1 Fab comprising a variable heavy chain (VH) domain and a variable light chain (VL) domain that does not compete for PD-1 binding with nivolumab and/or pembrolizumab are provided in FIGS. 70G-70I and the corresponding sequence listing.

An exemplary anti-PD-1 Fab, such as a non-competing anti-PD-1 Fab utilizes sequences including, but is not limited to, mAb A[PD-1]_H1L1, mAb B[PD-1]_H1L1, mAb C[PD-1]_H1L1, and mAb C[PD-1]_H1.19L10. In some embodiments, an illustrative anti-PD-1 Fab utilizes a VH domain selected from the group consisting of mAb C[PD-1]_H1, mAb C[PD-1]_H1.19, mAb C[PD-1]_H1.48, mAb C[PD-1]_H1.125, mAb C[PD-1]_H1.130, mAb C[PD-1]_ H1.132, mAb C[PD-1]_H1.169, mAb C[PD-1]_H1.175, and mAb C[PD-1]_H2; and a VL domain selected from the group consisting of mAb C[PD-1]_11, mAb C[PD-1]_L1.1, mAb C[PD-1]_L1.3, mAb C[PD-1]_L1.45, mAb C[PD-1]_ L1.117, mAb C[PD-1]_L1.129, mAb C[PD-1]_L1.135, mAb C[PD-1]_L1.136, mAb C[PD-1]_L1.140, and mAb C[PD-1]_L2, as provided in FIGS. 70G-70I and the corresponding sequence listing. Additional anti-PD-1 scFv includes sequences such as, but not limited to, those of mAb C[PD-1]_H1.1_L1 to mAb C[PD-1] H1.168_L1 as mentioned in FIGS. 75A-75E and mAb_C[PD-1]_H1_L1.1 to mAb_C[PD-1]_H1_L1.134 as mentioned in FIGS. 75E-75I.

In some embodiments, the Fab binds human PD-L1. Amino acid sequences of an illustrative anti-PD-L1 Fab comprising a variable heavy chain (VH) domain and a variable light chain (VL) domain are provided in FIGS. 76A-76J. In some embodiments, an illustrative anti-PD-L1 Fab utilizes a VH domain and a VL domain as represented as YW243.55.S70, MPDL3280A, durvalumab, atezolizumab, 12A4, 3G10, 10A5, h3D10 Var 1, h3D10 Var 2, h3D10 Var 3, h3D10 Var 4, h3D10 Var 5, h3D10 Var 6, h3D10 Var 7, h3D10 Var 8, h3D10 Var 9, h3D10 Var 10, h3D10 Var 11, h3D10 Var 12, h3D10 Var 13, h3D10 Var 14, Antibody A, C5H9v2, humanized 29E.2A3, 1B9, 4H1, mAb-42, BAP058-03, BAP058-04, BAP058-06, BAP058-07, BAP058-11, BAP058-13, H6, RC5, SH1A1Q, SH1B3, SH1D1, SH1D2, SH1D12, SH1E1, SH1G9, SH1E6, SH1A2, SH1B1, H6B1L, H6A1, H6B1, H6B2, G12, RSA1, RA3, SH1E2, SH1E4, SH1B1, SH1C8, H1H9364P2, H1H9373P2, H1H8314N, and PDL1, as provided in FIGS. 76A-76J and the corresponding sequence listing.

Exemplary embodiments of the PD-1 targeted sc-IL12 format format include, but are not limited to the constructs and amino acid sequences depicted in FIGS. 80A-80J, 81A-81B, 98A, 98B, 99A, 99B, 100A-100D, 101A-101D, 102A-102D, 103A-103D, 104A-104D, and 105A-105D. In some cases, exemplary embodiments of a PD-1 targeted Fab x sc-IL12 Fc fusion protein include XENP33686, XENP33687, XENP33693, XENP33694, XENP33695, XENP33696, and XENP33697, which are provided in the sequence listing.

In other cases, exemplary embodiments of the PD-1 targeted Fab x sc-IL12 format include XENP28792, XENP28793, XENP28794, XENP28796, XENP31073, XENP31074, XENP31106, XENP31136, XENP31137, XENP31140, XENP31460, XENP31461, XENP31462, XENP31585, XENP31586, XENP32192, XENP32193, XENP32194, and XENP32195 as depicted in the sequences provided FIGS. 80A-80J and 81A-81B and the sequence listing. For instance, the first monomer of a PD-1 targeted Fab x scIL12×scIL-12-Fc such as XENP32195 utilizes the sequence of chain 1-human_IL12p40_E59K/K99E/C252S/ K264E_(GGGGS)5-human_IL12p35_(GGGGS)2_(single-chain)_Fc(216)_IgG1_pI(-)_Isosteric_A_C220S/PVA_/ S267K/L368D/K370S, the second monomer utilizes the sequence of chain 2-mAb C[PD-1]_H1IgG1_PVA_/S267K/ S364K/E357Q, and the third monomer utilizes the sequence of chain 3-mAb C[PD-1]_L1.1.

Exemplary embodiments of the PD-L1 targeted single-chain IL-12 format include, but are not limited to, the constructs and amino acid sequences depicted in FIGS. 114A-114B, 115A-115D, 116-116D, 117A-117D, 118A-118D, 119A-119D, 120A-120D, and 121A-121D as well as the sequence listing.

Exemplary embodiments of the RSV targeted single-chain IL12 format format include, but are not limited to the constructs and amino acid sequences depicted in FIGS. 106, 107A-107B, 108A-108D, 109A-109D, 110A-110D, 111A-111D, 112A-112D, and 113A-113D as well as the sequence listing. In some cases, exemplary embodiments of a RSV targeted Fab x scIL12 fusion protein include XENP33684, XENP33685, XENP33688, XENP33689, XENP33690, XENP33691, and XENP33692.

In this format, useful variant IL-12p40 subunits include, but are not limited to, E59K/C252S, E59K/N200Q, E59K/K99E/N200Q, E59K/K99Y/N200Q, E59K/K99E/N200Q/C252S, E59K/K99Y/N200Q/C252S, E59K/K99E/N200Q/K264E, D18K/E59K/K99E/N200Q, D18K/E59K/K99E/C252S, D18K/E59K/K99E/N200Q/C252S, D18K/E59K/K99E/N200Q/K264E, D18K/E59K/K99E/C252S/K264E, D18K/E59K/K99E/N200Q/C252S/K264E, D18K/E59K/K99E, D18K/E59K/K99E/C252S, D18K/E59K/K99E/C252S/K264E, D18K/E59K/K99E/K264E, E32Q/D34N/E59K/K99E, E59K/K99E, E59K/K99E/C252S/K264E, and E59K/K99E/K264E, and E59K/K99Y. In some embodiments, the variant IL-12p40 of this format also include one or more glycosylation modification selected from the group consisting of N103D, N103Q, N113D, N113Q, N200D, N200Q, N281D, and N281Q.

In this format, useful variant IL-12p35 subunits include, but are not limited to, one or more substitutions selected from the group consisting of N71D, N71Q, N85D, N85Q, N195D, and N195Q.

In some embodiments, a PD-1 targeted Fab x scIL-12 heterodimeric Fc fusion protein comprises any one of the Fabs that bind PD-1 as described herein, a variant IL-12p40 subunit comprising one or more sets of amino acid substitutions selected from the group consisting of E59K/C252S, E59K/N200Q, E59K/K99E/N200Q, E59K/K99Y/N200Q, E59K/K99E/N200Q/C252S, E59K/K99Y/N200Q/C252S, E59K/K99E/N200Q/K264E, D18K/E59K/K99E/N200Q, D18K/E59K/K99E/C252S, D18K/E59K/K99E/N200Q/C252S, D18K/E59K/K99E/N200Q/K264E, D18K/E59K/K99E/C252S/K264E, D18K/E59K/K99E/N200Q/C252S/K264E, D18K/E59K/K99E, D18K/E59K/K99E/C252S, D18K/E59K/K99E/C252S/K264E, D18K/E59K/K99E/K264E, E32Q/D34N/E59K/K99E, E59K/K99E, E59K/K99E/C252S/K264E, and E59K/K99E/K264E, E59K/K99Y, N103D, N103Q, N113D, N113Q, N200D, N200Q, N281D, and N281Q; and a wildtype (unmodified) IL-12p35 subunit.

In some embodiments, a PD-L1 targeted Fab x scIL-12 heterodimeric Fc fusion protein comprises any one of the Fabs that bind PD-L1 as described herein, a variant IL-12p40 subunit comprising one or more sets of amino acid substitutions selected from the group consisting of E59K/C252S, E59K/N200Q, E59K/K99E/N200Q, E59K/K99Y/N200Q, E59K/K99E/N200Q/C252S, E59K/K99Y/N200Q/C252S, E59K/K99E/N200Q/K264E, D18K/E59K/K99E/N200Q, D18K/E59K/K99E/C252S, D18K/E59K/K99E/N200Q/C252S, D18K/E59K/K99E/N200Q/K264E, D18K/E59K/K99E/C252S/K264E, D18K/E59K/K99E/N200Q/C252S/K264E, D18K/E59K/K99E, D18K/E59K/K99E/C252S, D18K/E59K/K99E/C252S/K264E, D18K/E59K/K99E/K264E, E32Q/D34N/E59K/K99E, E59K/K99E, E59K/K99E/C252S/K264E, and E59K/K99E/K264E, E59K/K99Y, N103D, N103Q, N113D, N113Q, N200D, N200Q, N281D, and N281Q; and a wildtype (unmodified) IL-12p35 subunit.

In some embodiments, a PD-1 targeted Fab x scIL-12 heterodimeric Fc fusion protein comprises any one of the Fabs that bind PD-1 as described herein, a variant IL-12p40 subunit comprising one or more sets of amino acid substitutions selected from the group consisting of E59K/C252S, E59K/N200Q, E59K/K99E/N200Q, E59K/K99Y/N200Q, E59K/K99E/N200Q/C252S, E59K/K99Y/N200Q/C252S, E59K/K99E/N200Q/K264E, D18K/E59K/K99E/N200Q, D18K/E59K/K99E/C252S, D18K/E59K/K99E/N200Q/C252S, D18K/E59K/K99E/N200Q/K264E, D18K/E59K/K99E/C252S/K264E, D18K/E59K/K99E/N200Q/C252S/K264E, D18K/E59K/K99E, D18K/E59K/K99E/C252S, D18K/E59K/K99E/C252S/K264E, D18K/E59K/K99E/K264E, E32Q/D34N/E59K/K99E, E59K/K99E, E59K/K99E/C252S/K264E, and E59K/K99E/K264E, E59K/K99Y, N103D, N103Q, N113D, N113Q, N200D, N200Q, N281D, and N281Q; and a variant IL-12p35 subunit comprising one or more substitutions selected from the group consisting of N71D, N71Q, N85D, N85Q, N195D, and N195Q.

In some embodiments, a PD-L1 targeted Fab x scIL-12 heterodimeric Fc fusion protein comprises any one of the Fabs that bind PD-L1 as described herein, a variant IL-12p40 subunit comprising one or more sets of amino acid substitutions selected from the group consisting of E59K/C252S, E59K/N200Q, E59K/K99E/N200Q, E59K/K99Y/N200Q, E59K/K99E/N200Q/C252S, E59K/K99Y/N200Q/C252S, E59K/K99E/N200Q/K264E, D18K/E59K/K99E/N200Q, D18K/E59K/K99E/C252S, D18K/E59K/K99E/N200Q/C252S, D18K/E59K/K99E/N200Q/K264E, D18K/E59K/K99E/C252S/K264E, D18K/E59K/K99E/N200Q/C252S/K264E, D18K/E59K/K99E, D18K/E59K/K99E/C252S, D18K/E59K/K99E/C252S/K264E, D18K/E59K/K99E/K264E, E32Q/D34N/E59K/K99E, E59K/K99E, E59K/K99E/C252S/K264E, and E59K/K99E/K264E, E59K/K99Y, N103D, N103Q, N113D, N113Q, N200D, N200Q, N281D, and N281Q; and a variant IL-12p35 subunit comprising one or more substitutions selected from the group consisting of N71D, N71Q, N85D, N85Q, N195D, and N195Q.

C. Targeted mAb x Fc-scIL-12 Format

Figure 79C:
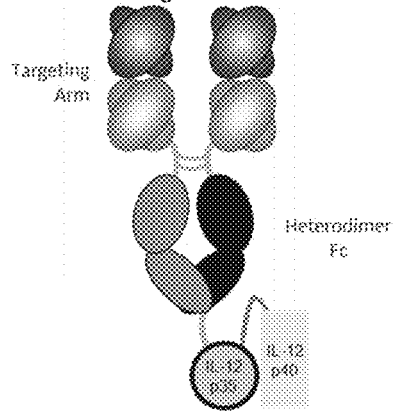

In an additional embodiment, the present invention provides the mAb-C-terminal single-chain IL-12-Fc fusion or "mAb-scIL-12" format, as shown in FIG. 79C. In this embodiment, IL-12 heterodimeric Fc fusion protein comprises three monomers (although the fusion protein is a tetramer). The mAb (which can be referred to as the targeting arm) represents an antigen binding domain. The mAb-scIL-12 format comprises (a) a first monomer comprising a first VH domain fused (linked) to the N-terminus of a first Fc domain, (b) a second VH domain fused (linked) to the N-terminus of a second Fc domain which is fused at its C-terminus to the N-terminus of a scIL-12, and (c) a third monomer comprises a light chain. As above, the scIL-12 may be "scIL-12(p40/p35)", wherein the IL-12p40 subunit or variant IL-12p40 subunit is N-terminally linked (with or without a domain linker) to the IL-12p35 subunit, or variant IL-12p35 subunit or "scIL-12(p35/p40)", wherein the IL-12p35 subunit or variant IL-12p35 subunit is N-terminally linked (with or without a domain linker) to the IL-12p40 subunit or variant IL-12p40 subunit. In some embodiments, the first monomer comprises a heavy chain of an antigen binding domain. In other words, the first monomer comprises from N- to C-terminal: VH-CH1-hinge-CH2-CH3. In some embodiments, the second monomer comprises a heavy chain of an antigen binding domain linked to a scIL-12 (e.g., an IL-12p35/p40 or IL-12p40/p35). In some embodiments, the second monomer comprises VH-CH1-hinge-CH2-CH3-domain linker-IL-12p35 subunit-domain linker-IL-12p40 subunit. In some embodiments, the second monomer comprises VH-CH1-hinge-CH2-CH3-domain linker-IL-12p40 subunit-domain linker-IL-12p35 subunit. In some instances, the domain linker between the IL-12p35 subunit and IL-12p40 subunit is optional.

The "mAb-scIL-12" format (see, e.g., FIG. 79C) comprises VH fused to the N-terminus of a first and a second heterodimeric Fc, with a scIL-12 fused to the C-terminus of one of the heterodimeric Fc-regions, while corresponding light chains are transfected separately so as to form a Fab with the VH. It should be noted that in this format, the position of the IL-12p40 subunit and IL-12p35 subunit can be swapped.

In this format, useful Fc variants include, but are not limited to, skew variants, pI variants, isosteric variants, FcγR variants, ablation variants, and any combination thereof, as for example, described herein. In the mAb-scIL-12 format, a preferred embodiment utilizes the skew variant pair S364K/E357Q:L368D/K370S. In some embodiments, the first variant Fc domain includes the skew variant S364K/E357Q and the second variant Fc domain includes the skew variant L368D/K370S. In some embodiments, the first variant Fc domain includes the skew variant L368D/K370S and the second variant Fc domain includes the skew variant S364K/E357Q.

In some embodiments, the antigen binding domain of the mAb-scIL12 format binds human PD-1. In certain embodiments, the antigen binding domain binds human PD-1 does not compete for human PD-1 with nivolumab and/or pembrolizumab. In some instances, the antigen binding domain binds a different epitope than nivolumab. In some instances, the antigen binding domain binds a different epitope than pembrolizumab. In some embodiments, the antigen binding domain binds human PD-L1. Illustrative antigen binding domains that target human PD-1 and human PD-L1 are described above.

D. Targeted Central IL-12-Fc Format

Figure 79D:
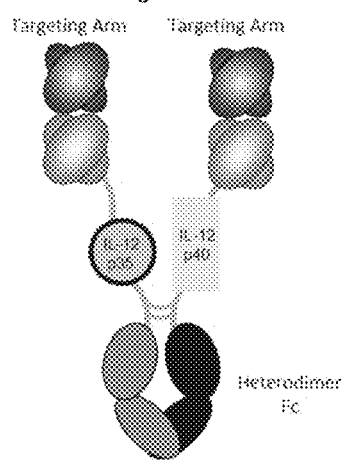

In an additional embodiment, the present invention provides the central IL-12-Fc fusion or "central IL-12-Fc" format, as shown in FIG. 79D. In this embodiment, IL-12 heterodimeric Fc fusion protein comprises three monomers (although the fusion protein is a tetramer). The targeting arm of the central IL-12-Fc represents an antigen binding domain. This format includes (a) a first monomer comprising a VH domain of an antigen binding domain is fused to the N-terminus of IL-12p35 subunit or variant IL-12p35 subunit which is fused at its C-terminus to the N-terminus of a first Fc domain, (b) a second monomer comprising a VH domain of an antigen binding domain is fused to the N-terminus of an IL-12p40 subunit or variant IL-12p40 subunit which is fused at its C-terminus to the N-terminus of a second Fc domain, and (c) a third monomer comprising a light chain of the antigen binding domain which are transfected separately and form an antigen binding domain with the VH domains.

The "central-IL-12" format (see, e.g., FIG. 79D) comprises a VH recombinantly fused to the N-terminus of a human IL-12p40 subunit which is then further fused to one side of a heterodimeric Fc and a VH recombinantly fused to the N-terminus of human IL-12p35 subunit which is then further fused to the other side of the heterodimeric Fc, while corresponding light chains are transfected separately so as to form a Fabs with the VHs. It should be noted that in this format, the position of the IL-12p40 subunit and IL-12p35 subunit can be swapped.

In this format, useful Fc variants include, but are not limited to, skew variants, pI variants, isosteric variants, FcγR variants, ablation variants, and any combination thereof, as for example, described herein. In the central IL-12-Fc format, a preferred embodiment utilizes the skew variant pair S364K/E357Q:L368D/K370S. In some embodiments, the first variant Fc domain includes the skew variant S364K/E357Q and the second variant Fc domain includes the skew variant L368D/K370S. In some embodiments, the first variant Fc domain includes the skew variant L368D/K370S and the second variant Fc domain includes the skew variant S364K/E357Q.

In some embodiments, the antigen binding domain such as a Fab of the central IL-12-Fc binds human PD-1. In certain embodiments, the antigen binding domain binds human PD-1 does not compete for human PD-1 with nivolumab and/or pembrolizumab. In some instances, the antigen binding domain binds a different epitope than nivolumab. In some instances, the antigen binding domain binds a different epitope than pembrolizumab. In some embodiments, the antigen binding domain binds human PD-L1. Illustrative antigen binding domains that target human PD-1 and human PD-L1 are described above.

E. Targeted Central scIL-12-Fc Format

Figure 79E:
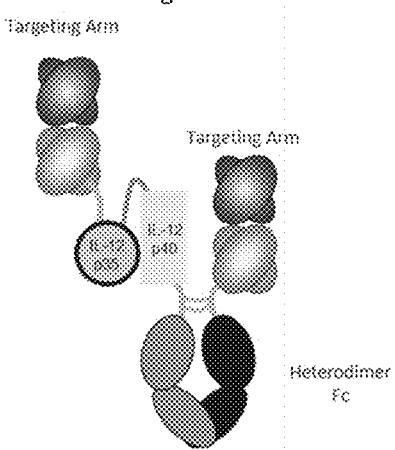

In an additional embodiment, the present invention provides the central single-chain IL-12-Fc fusion or "central scIL-12-Fc" format, as shown in FIG. 79E. In this embodiment, IL-12 heterodimeric Fc fusion protein comprises three monomers (although the fusion protein is a tetramer). The central -scIL-12 format comprises (a) a first heavy chain domain (VH-CH1) fused (linked) to the N-terminus of a scIL-12, which is fused at its C-terminus to the N-terminus of a first Fc domain, (b) a second monomer comprising a heavy chain comprising VH-CH1-hinge-CH2-CH3 such that the CH2-CH3 is a second Fc domain, and (c) a third monomer comprises a light chain (VL-CL). As above, the scIL-12 may be "scIL-12(p40/p35)", wherein the IL-12p40 subunit or variant IL-12p40 subunit is N-terminally linked (with or without a domain linker) to the IL-12p35 subunit or variant IL-12p35 subunit, or "scIL-12(p35/p40)", wherein the IL-12p35 subunit or variant IL-12p35 subunit is N-terminally linked (with or without a domain linker) to the IL-12p40 subunit or variant IL-12p40 subunit.

In some embodiments, the second monomer comprises a heavy chain of an antigen binding domain. In other words, the second monomer comprises from N- to C-terminal: VH-CH1-hinge-CH2-CH3. In some embodiments, the first monomer comprises a heavy chain of an antigen binding domain linked to a scIL-12 (e.g., an IL-12p35/p40 or IL-12p40/p35). In some embodiments, the first monomer comprises VH-CH1-domain linker-IL-12p35 subunit-domain linker-IL-12p40 subunit-CH2-CH3. In some embodiments, the first monomer comprises VH-CH1-domain linker-IL-12p40 subunit-domain linker-IL-12p35 subunit-CH2-CH3. In some instances, the domain linker between the IL-12p35 subunit and IL-12p40 subunit is optional.

The "central-scIL-12" format (see, e.g., FIG. 79E) comprises a VH fused to the N-terminus of scIL-12 which is then further fused to one side of a heterodimeric Fc and a VH fused to the other side of the heterodimeric Fc, while corresponding light chains are transfected separately so as to form a Fabs with the VHs. It should be noted that in this format, the position of the IL-12p40 subunit and IL-12p35 subunit can be swapped.

In this format, useful Fc variants include, but are not limited to, skew variants, pI variants, isosteric variants, FcγR variants, ablation variants, and any combination thereof, as for example, described herein. In the mAb-scIL-12 format, a preferred embodiment utilizes the skew variant pair S364K/E357Q and L368D/K370S. In some embodiments, the first variant Fc domain includes the skew variant S364K/E357Q and the second variant Fc domain includes the skew variant L368D/K370S. In some embodiments, the first variant Fc domain includes the skew variant L368D/K370S and the second variant Fc domain includes the skew variant S364K/E357Q.

In some embodiments, the antigen binding domain of the central IL-12-Fc binds human PD-1. In certain embodiments, the antigen binding domain binds human PD-1 does not compete for human PD-1 with nivolumab and/or pembrolizumab. In some instances, the antigen binding domain binds a different epitope than nivolumab. In some instances, the antigen binding domain binds a different epitope than pembrolizumab. In some embodiments, the Fab binds human PD-L1. Illustrative antigen binding domains that target human PD-1 and human PD-L1 are described above.

VIII. Useful Embodiments of the Invention

As will be appreciated by those in the art and discussed more fully below, the heterodimeric fusion proteins of the present invention can take on a wide variety of configurations, as are generally depicted in FIGS. 79A-79E. In some embodiments, the IL-12 heterodimeric Fc fusion protein targets human PD-1. In some embodiments, the IL-12 heterodimeric Fc fusion protein targets human PD-L1.

In some aspects, provided herein are IL-12 heterodimeric Fc fusion proteins of the targeted scFv x scIL-12-Fc format, such as an anti-PD-1 scFv x scIL-12-Fc fusion protein and an anti-PD-L1 scFv x scIL-12-Fc fusion protein. Also, provided herein are IL-12 heterodimeric Fc fusion proteins of the targeted Fab x scIL-12-Fc format, such as an anti-PD-1 Fab x scIL-12-Fc fusion protein and an anti-PD-L1 Fab x scIL-12-Fc fusion protein.

The amino acid sequences of exemplary fusion proteins of the anti-PD-1 Fab x scIL-12-Fc fusion are provided in FIGS. 80A-80J and 81A-81B. In some embodiments, provided herein are PD-1 targeted Fab x scIL12-Fc fusion proteins including, but not limited to, XENP28792, XENP28793, XENP28794, XENP28796, XENP31073, XENP31074, XENP31106, XENP31136, XENP31137, XENP31140, XENP31460, XENP31461, XENP31462, XENP31585, XENP31586, XENP32192, XENP32193, XENP32194, and XENP32195, as depicted in the amino acid sequences provided in FIGS. 80A-80J and 81A-81B and also the sequence listing. Also provided are PD-L1 targeted scIL-12 fusion proteins including, but not limited to, XENP31108, XENP31463, XENP31464, and XENP31465, as represented in FIGS. 81A-81B and 83B.

A useful embodiment of a targeted IL-12 heterodimeric Fc fusion protein comprises a first monomer (first fusion protein) comprising a single-chain IL-12 complex ("scIL-12") covalently attached (optionally via a domain linker) to the N-terminus of a first Fc domain, and a second monomer (second fusion protein; also referred to as a targeting arm) comprising an scFv or a Fab and second Fc domain. The scIL-12 may be "scIL-12(p40/p35)", wherein the IL-12p40 subunit is N-terminally linked (with or without a domain linker) to the IL-12p35 subunit, or "scIL-12(p35/p40)", wherein the IL-12p35 is N-terminally linked (with or without a domain linker) to the IL-12p40 subunit. In some embodiments, the IL-12p40 subunit of the targeted IL-12 Fc fusion protein is a variant IL-12p40 subunit. In some particular such embodiments, the IL-12p40 subunit is a variant IL-12p40 subunit having reduced heterogeneity. In other particular such embodiments, the IL-12p40 subunit is a variant IL-12p40 subunit having altered, that is either reduced or increased, affinity for IL-12 receptor subunit beta-1 (IL-12R(31), IL-12 receptor subunit beta-2 (IL-12R (32), and/or IL-12 receptor complex.

In some embodiments, the variant IL-12p40 subunit has one or more amino acid modifications at amino acid residues selected from the group consisting of E3, D7, E12, D14, W15, P17, D18, A19, P20, G21, E22, M23, D29, E32, E33, D34, L40, D41, Q42, S43, E45, L47, T54, I55, Q56, K58, E59, F60, G61, D62, Q65, Y66, E73, K84, E86, D87, G88, I89, W90, D93, D97, K99, E100, K102, N103, K104, F106, E110, N113, Y114, D129, D142, Q144, E156, R159, D161, N162, K163, D166, D170, Q172, D174, A176, C177, P178, A179, A180, E181, S183, P185, E187, N200, S204, F206, R208, D209, D214, N218, Q220, N226, Q229, E231, E235, T242, P243, S245, Y246, F247, S248, C252, Q256, K258, K260, E262, K264, D265, D270, N281, Q289, D290, R291, Y292, Y293, and E299 (numbered according to the human IL-12 subunit beta (IL-12p40) mature form sequence). In some embodiments, the variant IL-12p40 subunit has one or more amino acid substitutions selected from the group consisting of D18K, D18N, E32Q, E33Q, D34K, D34N, Q42E, S43E, S43K, E45Q, Q56E, E59K, E59Q, D62N, E73Q, D87N, K99E, K99Y, E100Q, N103D, N103Q, N113D, N113Q, Q144E, R159E, D161N, K163E, E187Q, N200D, N200Q, N218Q, Q229E, E235Q, C252S, Q256N, K258E, K260E, E262Q, K264E, N281D, N281Q, and E299Q. In some embodiments, the variant IL-12p40 subunit has amino acid substitutions selected from the group consisting of E59K/C252S, E59K/N200Q, E59K/K99E/N200Q, E59K/K99Y/N200Q, E59K/K99E/N200Q/C252S, E59K/K99Y/N200Q/C252S, E59K/K99E/N200Q/K264E, D18K/E59K/K99E/N200Q, D18K/E59K/K99E/C252S, D18K/E59K/K99E/N200Q/C252S, D18K/E59K/K99E/N200Q/K264E, D18K/E59K/K99E/C252S/K264E, D18K/E59K/K99E/N200Q/C252S/K264E, D18K/E59K/K99E, DIRK/E59K/K99E/C252S, D18K/E59K/K99E/C252S/K264E, D18K/E59K/K99E/K264E, E32K/D34N/E59K/K99E, E32Q/D34N/E59K/K99E, D34K/E59K/K99E, D34N/E59K, D34N/E59K/K99E, Q42E/E45Q, Q42E/E59Q, Q42E/Q56E/E59Q, E32Q/E59Q, D34N/E59Q, S43E/E59Q, S43K/E49Q, E45K/E59K/K99E, E45Q/Q56E, E45Q/Q56E/E59Q, E59Q/E187Q, E59Q/K163E, E59Q/K99E, E59Q/K258E, E59Q/K260E, E59K/K99E, E59K/K99E/N103Q/C252S/K264E E59K/K99E/Q144E, E59K/K99E/Q144K, E59K/K99E/R159E, E59K/K99E/K264E, E59K/K99E/C252S, E59K/K99E/C252S/K264E, E59K/K99Y, E59K/K99Y/C252S, E59Y/K99E, E59Y/K99Y, E59K/K99E/N113Q/C252S/K264E, E59K/K99E/N200Q/C252S/K264E, E59K/K99E/N281Q/C252S/K264E, E59K/K99E/N103Q/N113Q/C252S/K264E, E59K/K99E/N103Q/N200Q/C252S/K264E, E59K/K99E/N103Q/N281Q/C252S/K264E, E59K/K99E/N113Q/N200Q/C252S/K264E, E59K/K99E/N113Q/N281Q/C252S/K264E, E59K/K99E/N200Q/N281Q/C252S/K264E, E59K/K99E/N103Q/N113Q/N200Q/C252S/K264E, E59K/K99E/N103Q/N200Q/N281Q/C252S/K264E, E59K/K99E/N113Q/N200Q/N281Q/C252S/K264E, E59K/K99E/N103Q/N113Q/N200Q/N281Q/C252S/K264E, N103D/N113D, N103D/N113D/N200D, N103D/N113D/N281D, N103D/N200D, N103D/N200D/N281D, N103D/N281D, N103D/N113D/N200D/N281D, N103Q/N113Q, N103Q/N113Q/N200Q, N103Q/N113Q/N281Q, N103Q/N200Q, N103Q/N200Q/N281Q, N103Q/N281Q, N113D/N200D, N113D/N200D/N281D, N113D/N281D, N113Q/N200Q, N113Q/N281Q, N113Q/N200Q/N281Q, N103Q/N113Q/N200Q/N281Q, N200D/N281D, and N200Q/N281Q. In some embodiments, the IL-12p40 variant has a polypeptide sequence selected from the group consisting of i i) SEQ ID NO:57 (IL-12p40(N103D)), ii) SEQ ID NO:58 (IL-12p40 (N113D)), iii) SEQ ID NO:59 (IL-12p40(N200D)), iv) SEQ ID NO:60 (IL-12p40(N281D)), v) SEQ ID NO:61 (IL-12p40(N103D/N113D/N200D/N281D)), vi) SEQ ID NO:62 (IL-12p40(Q42E)), vii) SEQ ID NO:63 (IL-12p40(E45Q)), viii) SEQ ID NO:64 (IL-12p40(Q56E)), ix) SEQ ID NO:65 (IL-12p40(E59Q)), x) SEQ ID NO:66 (IL-12p40(D62N)), xi) SEQ ID NO:67 (IL-12p40(Q42E/E45Q)), xii) SEQ ID NO:68 (IL-12p40(E45Q/Q56E)), xiii) SEQ ID NO:69 (IL-12p40(Q42E/E59Q)), xiv) SEQ ID NO:70 (IL-12p40 (Q56E/E59Q)), xv) SEQ ID NO:71 (IL-12p40(Q42E/E45Q/Q56E)), xvi) SEQ ID NO:72 (IL-12p40(E45Q/Q56E/E59Q)), xvii) SEQ ID NO:73 (IL-12p40(D161N)), xviii) SEQ ID NO:74 (IL-12p40(E73Q)), xix) SEQ ID NO:75 (IL-12p40(Q144E)), xx) SEQ ID NO:76 (IL-12p40(E262Q)), xxi) SEQ ID NO:77 (IL-12p40(E100Q)), xxii) SEQ ID NO:78 (IL-12p40(D18N)), xxiii) SEQ ID NO:79 (IL-12p40(E33Q)), xxiv) SEQ ID NO:80 (IL-12p40(Q229E)), xxv) SEQ ID NO:81 (IL-12p40(E235Q)), xxvi) SEQ ID NO:82 (IL-12p40(Q256N)), xxvii) SEQ ID NO:83 (IL-12p40(E299Q)), xxviii) SEQ ID NO:84 (IL-12p40(D87N)), xxix) IL-12p40(E32Q), xxx) IL-12p40(D34N), xxxi) IL-12p40(S43E), xxxii) IL-12p40(S43K), xxxiii) SEQ ID NO:379 (IL-12p40 (E59K/K99E/N103Q/N113Q/N200Q/N281Q/C252S/K264E)), xxxiv) SEQ ID NO:205 (IL-12p40(K99E)), xxxv) IL-12p40(E59K)), xxxvi) IL-12p40(K163E), xxxvii) IL-12p40(E187Q), xxxviii) IL-12p40(K258E), xxxix) IL-12p40(K260E), xl) SEQ ID NO:206 (IL-12p40(E32Q/E59Q)), xli) SEQ ID NO:207 (IL-12p40(D34N/E59Q)), xlii) SEQ ID NO:208 (IL-12p40 (E59Q/E187Q)), xliii) SEQ ID NO:209 (IL-12p40(S43E/E59Q)), xliv) SEQ ID NO:210 (IL-12p40(S43K/E59Q)), xlv) SEQ ID NO:211 (IL-12p40(E59Q/K163E)), xlvi) SEQ ID NO:212 (IL-12p40(E59Q/K99E)), xlvii) SEQ ID NO:213 (IL-12p40(E59Q/K258E)), xlviii) SEQ ID NO:214 (IL-12p40(E59Q/K260E)), xlix) SEQ ID NO: 326 (IL-12p40 (D34N/E59K)) l) SEQ ID NO: 325 (IL-12p40(E59K/K99E)), li) SEQ ID NO: 339 (IL-12p40(D18K/E59K/K99E)), lii) SEQ ID NO: 343 (IL-12p40 (E59K/K99E/K264E)), liii) SEQ ID NO: 336 (IL-12p40 (E59K/K99Y)), liv) SEQ ID NO: 335 (IL-12p40 (E59Y/K99E)), lv) SEQ ID NO: 338 (IL-12p40 (E45K/E59K/K99E)), lvi) SEQ ID NO: 340 (IL-12p40 (E59K/K99E/Q144E)), lvii) SEQ ID NO: 341 (IL-12p40 (E59K/K99E/Q144K)), lviii) SEQ ID NO: 342 (IL-12p40 (E59K/K99E/R159E)), lix) SEQ ID NO: 343 (IL-12p40 (E59K/K99E/K264E)), lx) SEQ ID NO: 344 (IL-12p40 (D18K/E59K/K99E/K264E)), lxi) SEQ ID NO: 360 (IL-12p40 (C252S)), lxii) SEQ ID NO: 361 (IL-12p40 (D18K/E59K/K99E/C252S)), lxiii) SEQ ID NO: 362 (IL-12p40 (D18K/E59K/K99E/C252S/K264E)), lxiv) SEQ ID NO: 363 (IL-12p40 (E59K/K99Y/C252S)), lxv) SEQ ID NO: 364 (IL-12p40 (E59K/K99E/C252S/K264E)), lxvi) SEQ ID NO: 365 (IL-12p40 (E59K/K99E/C252S)), lxvii) SEQ ID NO: 254 (IL-12p40 (N103D/N113D)), lxviii) SEQ ID NO: 255 (IL-12p40 (N103D/N200D)), lxix) SEQ ID NO: 256 (IL-12p40 (N103D/N281D)), lxx) SEQ ID NO: 257 (IL-12p40 (N113D/N200D)), lxxi) SEQ ID NO: 258 (IL-12p40 (N113D/N281D)), lxxii) SEQ ID NO: 259 (IL-12p40 (N200D/N281D)), lxxiii) SEQ ID NO: 260 (IL-12p40 (N103D/N113D/N200D)), lxxiv) SEQ ID NO: 261 (IL-12p40 (N103D/N113D/N281D)), lxxv) SEQ ID NO: 262 (IL-12p40 (N103D/N200D/N281D)), lxxvi) SEQ ID NO: 263 (IL-12p40 (N113D/N200D/N281D)), lxxvii) SEQ ID NO: 264 (IL-12p40 (N103Q)), lxxviii) SEQ ID NO: 265 (IL-12p40 (N113Q)), lxxix) SEQ ID NO: 266 (IL-12p40 (N200Q)), lxxx) SEQ ID NO: 267 (IL-12p40 (N281Q)), lxxxi) SEQ ID NO: 268 (IL-12p40 (N103Q/N113Q)), lxxxii) SEQ ID NO: 269 (IL-12p40 (N103Q/N200Q)), lxxxiii) SEQ ID NO: 270 (IL-12p40 (N103Q/N281Q)), lxxxiv) SEQ ID NO: 271 (IL-12p40 (N113Q/N200Q)), lxxxv) SEQ ID NO: 272 (IL-12p40 (N113Q/N281Q)), lxxxvi) SEQ ID NO: 273 (IL-12p40 (N200Q/N281Q)), lxxxvii) SEQ ID NO: 274 (IL-12p40 (N103Q/N113Q/N200Q)), lxxxviii) SEQ ID NO: 275 (IL-12p40 (N103Q/N113Q/N281Q)), lxxxix) SEQ ID NO: 276 (IL-12p40 (N103Q/N200Q/N281Q)), xc) SEQ ID NO: 277 (IL-12p40 (N113Q/N200Q/N281Q)), xci) SEQ ID NO:278 (IL-12p40 (N103Q/N113Q/N200Q/N281Q)), xcii) SEQ ID NO:327 (IL-12p40 (D34N/E59K/K99E)), xciii) SEQ ID NO:328 (IL-12p40 (D34K/E59K/K99E)), xciv) SEQ ID NO:329 (IL-12p40 (E32Q/D34N/E59K/K99E)), xcv) SEQ ID NO:331 (IL-12p40 (E32K/D34N/E59K/K99E)), xcvi) SEQ ID NO: 337 (IL-12p40 (E59Y/K99Y)), xcvii) SEQ ID NO:366 (IL-12p40 (E59K/K99E/N103Q/C252S/K264E)), xcviii) SEQ ID NO:367 (IL-12p40 (E59K/K99E/N113Q/C252S/K264E)), xcix) SEQ ID NO:368 (IL-12p40 (E59K/K99E/N200Q/C252S/K264E)), c) SEQ ID NO:369 (IL-12p40 (E59K/K99E/N281Q/C252S/K264E)), ci) SEQ ID NO:370 (IL-12p40 (E59K/K99E/N103Q/N113Q/C252S/K264E)), cii) SEQ ID NO:371 (IL-12p40 (E59K/K99E/N103Q/N200Q/C252S/K264E)), ciii) SEQ ID NO:372 (IL-12p40 (E59K/K99E/N103Q/N281Q/C252S/K264E)), civ) SEQ ID NO:373 (IL-12p40 (E59K/K99E/N113Q/N200Q/C252S/K264E)), cv) SEQ ID NO:374 (IL-12p40 (E59K/K99E/N113Q/N281Q/C252S/K264E)), cvi) SEQ ID NO:375 (IL-12p40 (E59K/K99E/N200Q/N281Q/C252S/K264E)), cvii) SEQ ID NO:376 (IL-12p40 (E59K/K99E/N103Q/N113Q/N200Q/C252S/K264E)), cviii) SEQ ID NO:377 (IL-12p40 (E59K/K99E/N103Q/N200Q/N281Q/C252S/K264E)), and cix) SEQ ID NO:378 (IL-12p40 (E59K/K99E/N113Q/N200Q/N281Q/C252S/K264E)).

In some embodiments, the IL-12p35 subunit of targeted IL-12 Fc fusion protein is a variant IL-12p35 subunit. In some particular such embodiments, the IL-12p35 subunit is a variant IL-12p35 subunit having reduced heterogeneity. In other particular such embodiments, the IL-12p35 subunit is a variant IL-12p35 subunit having altered, that is either reduced or increased, affinity for IL-12 receptor subunit beta-1 (IL-12R(31), IL-12 receptor subunit beta-2 (IL-12R (32), and/or IL-12 receptor complex. In some embodiments, the variant IL-12p35 subunit has one or more amino acid modifications at amino acid residues selected from the group consisting Q20, N21, Q35, E38, S44, E45, E46, H49, K54, D55, T59, V60, E61, C63, L64, P65, E67, L68, N71, S73, C74, L75, N76, E79, N85, L89, F96, M97, L124, M125, Q130, Q135, N136, E143, Q146, N151, E153, K158, E162, E163, D165, I171, R181, I182, R183, V185, T186, D188, R189, V190, S192, Y193, N195, and A196 (numbered according to the human IL-12 subunit alpha (IL-12p35) mature form sequence). In some embodiments, the variant IL-12p35 subunit has one or more amino acid substitutions selected from the group consisting of N21D, Q35D, E38Q, D55Q, D55K, N71D, N71Q, L75A, N76D, E79Q, N85D, N85Q, L89A, F96A, M97A, L124A, M125A, Q130E, Q135E, N136D, E143Q, Q146E, N151D, N151K, E153K, E153Q, K158E, E162Q, E163Q, D165N, I171A, N195D, and N195Q. In some embodiments, the variant IL-12p35 subunit has amino acid substitutions N21D/N151D, D55Q/N151D, N71D/N85D, N71D/N85D/N195D, N71D/N195D, N71Q/N85Q, N71Q/N85Q/N195Q, N71Q/N195Q, E79Q/N151D, N85D/N195D, N85Q/N195Q, Q130E/N151D, N136D/N151D, E143Q/N151D, N151D/E153Q, N151D/D165N, and N151E/K158E. In some embodiments, the variant IL-12p35 subunit has a polypeptide sequence selected from the group consisting of: i) SEQ ID NO:113 (IL-12p35(N71D)), ii) SEQ ID NO:114 (IL-12p35(N85D)), iii) SEQ ID NO:115 (IL-12p35(N195D)), iv) SEQ ID NO:116 (IL-12p35(N71D/N85D/N195D)), v) SEQ ID NO:117 (IL-12p35(E153Q)), vi) SEQ ID NO:118 (IL-12p35 (E38Q)), vii) SEQ ID NO:119 (IL-12p35(N151D)), viii) SEQ ID NO:120 (IL-12p35(Q135E)), ix) SEQ ID NO:121 (IL-12p35(Q35D)), x) SEQ ID NO:122 (IL-12p35(Q146E)), xi) SEQ ID NO:123 (IL-12p35(N76D)), xii) SEQ ID NO:124 (IL-12p35(E162Q)), xiii) SEQ ID NO:125 (IL-12p35(E163Q)), xiv) (IL-12p35(N21D)), xv) SEQ ID NO:333 (IL-12p35(D55Q)), xvi) (IL-12p35(E79Q)), xvii) (IL-12p35(Q130E)), xviii) (IL-12p35(N136D)), xix) (IL-12p35(E143Q)), xx) SEQ ID NO:227 (IL-12p35(N151K)), xxi) SEQ ID NO:226 (IL-12p35(E153K)), xxii) (IL-12p35 (K158E)), xxiii) (IL-12p35(D165N)), xxiv) SEQ ID NO:225 (IL-12p35(N151D/E153Q)), xxv) SEQ ID NO:228 (IL-12p35(N151D/D165N)), xxvi) SEQ ID NO:229 (IL-12p35(Q130E/N151D)), xxvii) SEQ ID NO:230 (IL-12p35 (N151D/K158E)), xxviii) SEQ ID NO:231 (IL-12p35 (E79Q/N151D)), xxix) SEQ ID NO:232 (IL-12p35(D55Q/N151D)), xxx) SEQ ID NO:233 (IL-12p35(N136D/N151D)), xxxi) SEQ ID NO:234 (IL-12p35(N21D/N151D)), xxxii) SEQ ID NO:235 (IL-12p35(E143Q/N151D)), xxxiii) SEQ ID NO: 345 (IL-12p35(F96A)), xxxiv) SEQ ID NO: 346 (IL-12p35(M97A)), xxxv) SEQ ID NO: 347 (IL-12p35(L89A)), xxxvi) SEQ ID NO: 348 (IL-12p35(L124A)), xxxvii) SEQ ID NO: 349 (IL-12p35 (M125A)), xxxviii) SEQ ID NO: 350 (IL-12p35(L75A)), xxxiv) SEQ ID NO: 351 (IL-12p35(I171A)), xxxv) SEQ ID NO: 279 (IL-12p35 (N71Q)), xxxvi) SEQ ID NO: 280 (IL-12p35 (N85Q)), xxxvii) SEQ ID NO: 281 (IL-12p35 (N195Q)), xxxviii) SEQ ID NO: 282 (IL-12p35 (N71Q/N85Q)), xxxix) SEQ ID NO: 283 (IL-12p35 (N71Q/N195Q)), xl) SEQ ID NO: 284 (IL-12p35 (N85Q/N195Q), xli) SEQ ID NO: 285 (IL-12p35 (N71Q/N85Q/N195Q)), xlii) SEQ ID NO: 286 (IL-12p35 (N71D/N85D)), xliii) SEQ ID NO: 287 (IL-12p35 (N71D/N195D), xliv) SEQ ID NO: 288 (IL-12p35 (N85D/N195D)), xlv) SEQ ID NO: 333 (IL-12p35 (D55Q)), and xlvi) SEQ ID NO: 334 (IL-12p35 (D55K)).

In some embodiments, the variant IL-12p40 subunit domain of an illustrative targeted IL-12-Fc format comprises an amino acid sequence selected from the group consisting of SEQ ID NOS:57-84 and the amino acid sequences depicted in FIGS. 21A-21G and FIGS. 43A-43B. In certain embodiments, amino acid sequences of exemplary variant IL-12p40 subunits are provided in FIGS. 21A-21G, 26A-26L, 30A-30B, 34A-34G, 38, 43A-43B, 45A-45I, 50, 51, 65A-65B, 66A-66C, 67A-67N, 89A-89C, 90, 91A-91C, 92A-92C, 94, 91A-95C, 96A-96C, 97!-97C, 98A-98B, 99A-99B, 100A-100C, 102A, 102C, 103A-103C, 104A-104C, 105A-105C, 106, 107A-107B, 108A-108C, 109A-109C, 110A, 110C, 111A-111C, 112A-112C, 113A-113C, 114A, 115A-115C-116A-116C, 117A-117C, 118A-118D, 119A-119D, 120A-120D and 121A-121D as well as the

SEQUENCE LISTING

In some embodiments, the variant IL-12p35 subunit domain of an illustrative targeted IL-12-Fc format comprises an amino acid sequence selected from the group consisting of SEQ ID NOS:113-125 and the the amino acid sequences depicted FIGS. 24A-24C and FIG. 44. In certain embodiments, amino acid sequences of exemplary variant IL-12p35 subunits are provided in FIGS. 24A-24C, 25A, 25C, 26M-26Q, 32, 34H-34L, 39, 44, 45A-45I, and 67K-67N as well as the sequence listing.

In some embodiments, the variant IL-12p40 subunit domain of an illustrative targeted IL-12-Fc format comprises an amino acid sequence selected from the group consisting of SEQ ID NOS:57-84 and the amino acid sequences depicted in FIGS. 21A-21G and FIGS. 43A-43B. In some embodiments, the variant IL-12p35 subunit domain of an illustrative targeted IL-12-Fc format comprises an amino acid sequence selected from the group consisting of SEQ ID NOS:113-125 and the the amino acid sequences depicted FIGS. 24A-24C and FIG. 44.

In additional embodiments, a monomer containing a variant IL-12p40 subunit comprises a polypeptide sequence selected from the group consisting of: i) SEQ ID NO:47 (XENP27201 Chain 1), ii) SEQ ID NO:85 (XenD24752), iii) SEQ ID NO:86 (XenD24753), iv) SEQ ID NO:87 (XenD24754), v) SEQ ID NO:88 (XenD24755), vi) SEQ ID NO:89 (XenD24756), vii) SEQ ID NO:90 (XenD24757), viii) SEQ ID NO:91 (XenD24758), ix) SEQ ID NO:92 (XenD24759), x) SEQ ID NO:93 (XenD24760), xi) SEQ ID NO:94 (XenD24761), xii) SEQ ID NO:95 (XenD24762), xiii) SEQ ID NO:96 (XenD24763), xiv) SEQ ID NO:97 (XenD24764), xv) SEQ ID NO:98 (XenD24765), xvi) SEQ ID NO:99 (XenD24766), xvii) SEQ ID NO:100 (XenD24767), xviii) SEQ ID NO:101 (XenD24768), xix) SEQ ID NO:102 (XenD24769), xx) SEQ ID NO:103 (XenD24770), xxi) SEQ ID NO:104 (XenD24771), xxii) SEQ ID NO:105 (XenD24772), xxiii) SEQ ID NO:106 (XenD24773), xxiv) SEQ ID NO:107 (XenD24774), xxv) SEQ ID NO:108 (XenD24775), xxvi) SEQ ID NO:109 (XenD24776), xxvii) SEQ ID NO:110 (XenD24777), xxviii) SEQ ID NO:111 (XenD24778), xxix) SEQ ID NO:112 (XenD24792), xxx) SEQ ID NO:215 (XenD25922), xxxi) SEQ ID NO:216 (XenD25923), xxxii) SEQ ID NO:217 (XenD25924), xxxiii) SEQ ID NO:218 (XenD25925), xxxiv) SEQ ID NO:219 (XenD25926), xxxv) SEQ ID NO:220 (XenD25927), xxxvi) SEQ ID NO:221 (XenD25928), xxxvii) SEQ ID NO:222 (XenD25929), xxxviii) SEQ ID NO:223 (XenD25930), and xxxix) SEQ ID NO:224 (XenD25931); and a monomer containing a variant IL-12p35 subunit comprises a polypeptide sequence selected from the group consisting of: i) SEQ ID NO:113 (IL-12p35(N71D)), ii) SEQ ID NO:114 (IL-12p35(N85D)), iii) SEQ ID NO:115 (IL-12p35(N195D)), iv) SEQ ID NO:116 (IL-12p35(N71D/N85D/N195D)), v) SEQ ID NO:117 (IL-12p35(E153Q)), vi) SEQ ID NO:118 (IL-12p35 (E38Q)), vii) SEQ ID NO:119 (IL-12p35(N151D)), viii) SEQ ID NO:120 (IL-12p35(Q135E)), ix) SEQ ID NO:121 (IL-12p35(Q35D)), x) SEQ ID NO:122 (IL-12p35(Q146E)), xi) SEQ ID NO:123 (IL-12p35(N76D)), xii) SEQ ID NO:124 (IL-12p35(E162Q)), xiii) SEQ ID NO:125 (IL-12p35(E163Q)), xiv) (IL-12p35(N21D)), xv) SEQ ID NO:333 (IL-12p35(D55Q)), xvi) (IL-12p35(E79Q)), xvii) (IL-12p35(Q130E)), xviii) (IL-12p35(N136D)), xix) (IL-12p35(E143Q)), xx) SEQ ID NO:227 (IL-12p35(N151K)), xxi) SEQ ID NO:226 (IL-12p35(E153K)), xxii) (IL-12p35 (K158E)), xxiii) (IL-12p35(D165N)), xxiv) SEQ ID NO:225 (IL-12p35(N151D/E153Q)), xxv) SEQ ID NO:228 (IL-12p35(N151D/D165N)), xxvi) SEQ ID NO:229 (IL-12p35(Q130E/N151D)), xxvii) SEQ ID NO:230 (IL-12p35 (N151D/K158E)), xxviii) SEQ ID NO:231 (IL-12p35 (E79Q/N151D)), xxix) SEQ ID NO:232 (IL-12p35(D55Q/N151D)), xxx) SEQ ID NO:233 (IL-12p35(N136D/N151D)), xxxi) SEQ ID NO:234 (IL-12p35(N21D/N151D)), xxxii) SEQ ID NO:235 (IL-12p35(E143Q/N151D)), xxxiii) SEQ ID NO: 345 (IL-12p35(F96A)), xxxiv) SEQ ID NO: 346 (IL-12p35(M97A)), xxxv) SEQ ID NO: 347 (IL-12p35(L89A)), xxxvi) SEQ ID NO: 348 (IL- 12p35(L124A)), xxxvii) SEQ ID NO: 349 (IL-12p35 (M125A)), xxxviii) SEQ ID NO: 350 (IL-12p35(L75A)), xxxiv) SEQ ID NO: 351 (IL-12p35(I171A)), xxxv) SEQ ID NO: 279 (IL-12p35 (N71Q)), xxxvi) SEQ ID NO: 280 (IL-12p35 (N85Q)), xxxvii) SEQ ID NO: 281 (IL-12p35 (N195Q)), xxxviii) SEQ ID NO: 282 (IL-12p35 (N71Q/N85Q)), xxxix) SEQ ID NO: 283 (IL-12p35 (N71Q/N195Q)), xl) SEQ ID NO: 284 (IL-12p35 (N85Q/N195Q), xli) SEQ ID NO: 285 (IL-12p35 (N71Q/N85Q/N195Q)), xlii) SEQ ID NO: 286 (IL-12p35 (N71D/N85D)), xliii) SEQ ID NO: 287 (IL-12p35 (N71D/N195D), xliv) SEQ ID NO: 288 (IL-12p35 (N85D/N195D)), xlv) SEQ ID NO: 333 (IL-12p35 (D55Q)), and xlvi) SEQ ID NO: 334 (IL-12p35 (D55K)).

As described above, the antigen binding domain of the targeted IL-12 heterodimeric Fc fusion protein binds human PD-1. In certain embodiments, the antigen binding domain binds human PD-1 and does not compete for human PD-1 with nivolumab and/or pembrolizumab. In some instances, the antigen binding domain binds a different epitope than nivolumab. In some instances, the antigen binding domain binds a different epitope than pembrolizumab. In some embodiments, the antigen binding domain binds human PD-L1. Illustrative antigen binding domains that target human PD-1 and human PD-L1 are described above. Amino acid sequences of such antigen binding domains are depicted in FIGS. 70A-70I, 71, 72, 75A-75I, and 76A-76J as well as the sequence listing.

For any of the heterodimeric Fc fusion proteins outlined herein, the optional domain linkers used on the first monomer, on the second monomer, and/or in the scIL-12 can be the same or different. In addition, the first Fc domain and the second Fc domain of the heterodimeric protein can have different amino acid sequences.

The Fc domains of the present invention comprise IgG Fc domains, e.g., IgG1 Fc domains. In some embodiments, the first and second Fc domains comprising a set of amino acid substitutions selected from the group consisting of: L368D/K370S and S364K; L368D/K370S and S364K/E357L; L368D/K370S and S364K/E357Q; T411E/K360E/Q362E and D401K; L368E/K370S and S364K; K370S and S364K/E357Q; T366S/L368A/Y407V and T366W; and T366S/L368A/Y407V/Y349C and T366W/S354C, according to EU numbering. In some instances, the first and/or the second Fc domains of any of the heterodimeric Fc fusion formats outlined herein can have an additional set of amino acid substitutions comprising Q295E/N384D/Q418E/N421D, according to EU numbering. In some embodiments, the first and/or the second Fc domains have an additional set of amino acid substitutions consisting of G236R/L328R, E233P/L234V/L235A/G236del/S239K, E233P/L234V/L235A/G236del/S239K/A327G, E233P/L234V/L235A/G236del/S267K/A327G, E233P/L234V/L235A/G236del, and E233P/L234V/L235A/G236del/S267K, according to EU numbering.

In some embodiments, the targeted IL-12 Fc fusion proteins are further engineered for extending half-life by substitutions comprising M428L and N434S in the Fc domains. In some embodiments, the IL-12 Fc fusion proteins are further engineered for extending half-life by substitutions comprising M428L/N434S in the first and second variant Fc domains. Any of the targeted IL-12 Fc fusions listed herein may be engineered for extending half-life.

Additional heterodimerization variants can be independently and optionally included and selected from variants outlined in the figures. These compositions can further comprise ablation variants, pI variants, charged variants, isotypic variants, etc.

Many of the embodiments outlined herein rely in general on the central IL-12-Fc format of FIG. 79D comprising: a first monomer (first fusion protein) comprising a VH domain of a targeting arm is fused to the N-terminus of a variant IL-12p35 subunit domain covalently attached (optionally via a domain linker) to the N-terminus of a first Fc domain; a second monomer (second fusion protein) comprising a VH domain of a targeting arm is fused to the N-terminus of a variant IL-12p40 subunit domain covalently attached (optionally via a domain linker) to the N-terminus of a second Fc domain, and a third monomer comprising a light chain of the targeting arm.

A useful embodiment of a targeted IL-12 heterodimeric Fc fusion protein comprises a first monomer (first fusion protein; also referred to as a first targeting arm) comprising VH-CH1 covalently attached (optionally via a domain linker) to an IL-12p35 subunit domain, which is covalently attached (optionally via a domain linker) to the C-terminus of a first Fc domain, and a second monomer (second fusion protein; also referred to as a second targeting arm) comprising VH-CH1 covalently attached (optionally via a domain linker) to an IL-12p40 subunit domain, which is covalently attached (optionally via a domain linker) to the C-terminus of a second Fc domain.

IX. Nucleic Acids of the Invention

The invention further provides nucleic acid compositions encoding the heterodimeric Fc fusion protein, the IL-12 subunits, and the IL-12 heterodimeric complex of the invention (or, in the case of a monomer Fc domain protein, nucleic acids encoding those as well).

As will be appreciated by those in the art, the nucleic acid compositions will depend on the format of the heterodimeric protein. Thus, for example, when the format requires three amino acid sequences, three nucleic acid sequences can be incorporated into one or more expression vectors for expression. Similarly for some formats, only two nucleic acids are needed; again, they can be put into one or two expression vectors.

As is known in the art, the nucleic acids encoding the components of the invention can be incorporated into expression vectors as is known in the art, and depending on the host cells used to produce the heterodimeric Fc fusion proteins of the invention. Generally the nucleic acids are operably linked to any number of regulatory elements (promoters, origin of replication, selectable markers, ribosomal binding sites, inducers, etc.). The expression vectors can be extra-chromosomal or integrating vectors.

The nucleic acids and/or expression vectors of the invention are then transformed into any number of different types of host cells as is well known in the art, including mammalian, bacterial, yeast, insect and/or fungal cells, with mammalian cells (e.g. CHO cells), finding use in many embodiments.

In some embodiments, nucleic acids encoding each monomer, as applicable depending on the format, are each contained within a single expression vector, generally under different or the same promoter controls. In embodiments of particular use in the present invention, each of these two or three nucleic acids are contained on a different expression vector.

The heterodimeric Fc fusion protein of the invention are made by culturing host cells comprising the expression vector(s) as is well known in the art. Once produced, traditional fusion protein or antibody purification steps are done, including an ion exchange chromatography step. As discussed herein, having the pIs of the two monomers differ by at least 0.5 can allow separation by ion exchange chromatography or isoelectric focusing, or other methods sensitive to isoelectric point. That is, the inclusion of pI substitutions that alter the isoelectric point (pI) of each monomer so that each monomer has a different pI and the heterodimer also has a distinct pI, thus facilitating isoelectric purification of the heterodimer (e.g., anionic exchange chromatography, cationic exchange chromatography). These substitutions also aid in the determination and monitoring of any contaminating homodimers post-purification (e.g., IEF gels, cIEF, and analytical IEX columns).

X. Biological and Biochemical Functionality of IL-12 Heterodimeric Immunomodulatory Fc Fusion Proteins Generally the Fc fusion proteins of the invention are administered to patients with cancer, and efficacy is assessed, in a number of ways as described herein. Thus, while standard assays of efficacy can be run, such as cancer load, size of tumor, evaluation of presence or extent of metastasis, etc., immuno-oncology treatments can be assessed on the basis of immune status evaluations as well. This can be done in a number of ways, including both in vitro and in vivo assays. For example, evaluation of changes in immune status (e.g., presence of ICOS+ CD4+ T cells following ipi treatment) along with "old fashioned" measurements such as tumor burden, size, invasiveness, LN involvement, metastasis, etc. can be done. Thus, any or all of the following can be evaluated: the inhibitory effects of PVRIG on CD4$^+$ T cell activation or proliferation, CD8$^+$ T (CTL) cell activation or proliferation, CD8$^+$ T cell-mediated cytotoxic activity and/or CTL mediated cell depletion, NK cell activity and NK mediated cell depletion, the potentiating effects of PVRIG on Treg cell differentiation and proliferation and Treg- or myeloid derived suppressor cell (MDSC)-mediated immunosuppression or immune tolerance, and/or the effects of PVRIG on proinflammatory cytokine production by immune cells, e.g., IL-2, IFN-γ or TNF-α production by T or other immune cells.

In some embodiments, assessment of treatment is done by evaluating immune cell proliferation, using for example, CFSE dilution method, Ki67 intracellular staining of immune effector cells, and $^3$H-thymidine incorporation method, In some embodiments, assessment of treatment is done by evaluating the increase in gene expression or increased protein levels of activation-associated markers, including one or more of: CD25, CD69, CD137, ICOS, PD1, GITR, OX40, and cell degranulation measured by surface expression of CD107A.

In general, gene expression assays are done as is known in the art.

In general, protein expression measurements are also similarly done as is known in the art.

In some embodiments, assessment of treatment is done by assessing cytotoxic activity measured by target cell viability detection via estimating numerous cell parameters such as enzyme activity (including protease activity), cell membrane permeability, cell adherence, ATP production, co-enzyme production, and nucleotide uptake activity. Specific examples of these assays include, but are not limited to, Trypan Blue or PI staining, $^{51}$Cr or $^{35}$S release method, LDH activity, MTT and/or WST assays, Calcein-AM assay, Luminescent based assay, and others.

In some embodiments, assessment of treatment is done by assessing T cell activity measured by cytokine production, measure either intracellularly in culture supernatant using cytokines including, but not limited to, IFNγ, TNFα, GM-CSF, IL2, IL6, IL4, IL5, IL10, IL13 using well known techniques.

Accordingly, assessment of treatment can be done using assays that evaluate one or more of the following: (i) increases in immune response, (ii) increases in activation of αβ and/or -γδ T cells, (iii) increases in cytotoxic T cell activity, (iv) increases in NK and/or NKT cell activity, (v) alleviation of αβ and/or γδ T-cell suppression, (vi) increases in pro-inflammatory cytokine secretion, (vii) increases in IL-2 secretion; (viii) increases in interferon-γ production, (ix) increases in Th1 response, (x) decreases in Th2 response, (xi) decreases or eliminates cell number and/or activity of at least one of regulatory T cells (Tregs).

A. Assays to Measure Efficacy and Potency

In some embodiments, T cell activation is assessed using a Mixed Lymphocyte Reaction (MLR) assay as is known in the art. An increase in activity indicates immunostimulatory activity. Appropriate increases in activity are outlined below.

In one embodiment, the signaling pathway assay measures increases or decreases in immune response as measured for an example by phosphorylation or de-phosphorylation of different factors, or by measuring other post translational modifications. IL-12 mediates IFNγ expression and secretion through phosphorylation of STAT4 (Morinobu et al., 2002). Accordingly, in a preferred embodiment, the signaling pathway assay measure increases or decreases in immune response as indicated by phosphorylation of STAT4. An increase in activity indicates immunostimulatory activity. Appropriate increases in activity are outlined below.

In one embodiment, the signaling pathway assay measures increases or decreases in activation of αβ and/or γδ T cells as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in cytotoxic T cell activity as measured for an example by direct killing of target cells like for an example cancer cells or by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in NK and/or NKT cell activity as measured for an example by direct killing of target cells like for an example cancer cells or by cytokine secretion or by changes in expression of activation markers like for an example CD107a, etc. An increase in activity indicates immunostimulatory activity. Appropriate increases in activity are outlined below.

In one embodiment, the signaling pathway assay measures increases or decreases in αβ and/or γδ T-cell suppression, as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in pro-inflammatory cytokine secretion as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in IL-2 secretion as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in interferon-γ production as measured for example by ELISA or by Luminex or by Multiplex bead based methods or by intracellular staining and FACS analysis or by Alispot etc. An increase in activity indicates immunostimulatory activity. Appropriate increases in activity are outlined below.

In one embodiment, the signaling pathway assay measures increases or decreases in Th1 response as measured for an example by cytokine secretion or by changes in expression of activation markers. An increase in activity indicates immunostimulatory activity. Appropriate increases in activity are outlined below.

In one embodiment, the signaling pathway assay measures increases or decreases in Th2 response as measured for an example by cytokine secretion or by changes in expression of activation markers. An increase in activity indicates immunostimulatory activity. Appropriate increases in activity are outlined below.

In one embodiment, the signaling pathway assay measures increases or decreases cell number and/or activity of at least one of regulatory T cells (Tregs), as measured for example by flow cytometry or by IHC. A decrease in response indicates immunostimulatory activity. Appropriate decreases are the same as for increases, outlined below.

In one embodiment, the signaling pathway assay measures increases or decreases in M2 macrophages cell numbers, as measured for example by flow cytometry or by IHC. A decrease in response indicates immunostimulatory activity. Appropriate decreases are the same as for increases, outlined below.

In one embodiment, the signaling pathway assay measures increases or decreases in M2 macrophage pro-tumorigenic activity, as measured for an example by cytokine secretion or by changes in expression of activation markers. A decrease in response indicates immunostimulatory activity. Appropriate decreases are the same as for increases, outlined below.

In one embodiment, the signaling pathway assay measures increases or decreases in N2 neutrophils increase, as measured for example by flow cytometry or by IHC. A decrease in response indicates immunostimulatory activity. Appropriate decreases are the same as for increases, outlined below.

In one embodiment, the signaling pathway assay measures increases or decreases in N2 neutrophils pro-tumorigenic activity, as measured for an example by cytokine secretion or by changes in expression of activation markers. A decrease in response indicates immunostimulatory activity. Appropriate decreases are the same as for increases, outlined below.

In one embodiment, the signaling pathway assay measures increases or decreases in inhibition of T cell activation, as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in inhibition of CTL activation as measured for an example by direct killing of target cells like for an example cancer cells or by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in αβ and/or γδ T cell exhaustion as measured for an example by changes in expression of activation markers. A decrease in response indicates immunostimulatory activity. Appropriate decreases are the same as for increases, outlined below.

In one embodiment, the signaling pathway assay measures increases or decreases αβ and/or γδ T cell response as measured for an example by cytokine secretion or by proliferation or by changes in expression of activation markers like for an example CD137, CD107a, PD1, etc. An increase in activity indicates immunostimulatory activity. Appropriate increases in activity are outlined below.

In one embodiment, the signaling pathway assay measures increases or decreases in stimulation of antigen-specific memory responses as measured for an example by cytokine secretion or by proliferation or by changes in expression of activation markers like for an example CD45RA, CCR7 etc. An increase in activity indicates immunostimulatory activity. Appropriate increases in activity are outlined below.

In one embodiment, the signaling pathway assay measures increases or decreases in apoptosis or lysis of cancer cells as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases in stimulation of cytotoxic or cytostatic effect on cancer cells, as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases direct killing of cancer cells as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, the signaling pathway assay measures increases or decreases Th17 activity as measured for an example by cytokine secretion or by proliferation or by changes in expression of activation markers. An increase in activity indicates immunostimulatory activity. Appropriate increases in activity are outlined below.

In one embodiment, the signaling pathway assay measures increases or decreases in induction of complement dependent cytotoxicity and/or antibody dependent cell-mediated cytotoxicity, as measured for an example by cytotoxicity assays such as for an example MTT, Cr release, Calcine AM, or by flow cytometry based assays like for an example CFSE dilution or propidium iodide staining etc. An increase in activity indicates immunostimulatory activity. Appropriate increases in activity are outlined below.

In one embodiment, T cell activation is measured for an example by direct killing of target cells like for an example cancer cells or by cytokine secretion or by proliferation or by changes in expression of activation markers like for an example CD137, CD107a, PD1, etc. For T-cells, increases in proliferation, cell surface markers of activation (e.g., CD25, CD69, CD137, PD1), cytotoxicity (ability to kill target cells), and cytokine production (e.g., IL-2, IL-4, IL-6, IFNγ, TNF-α, IL-10, IL-17A) would be indicative of immune modulation that would be consistent with enhanced killing of cancer cells.

In one embodiment, NK cell activation is measured for example by direct killing of target cells like for an example cancer cells or by cytokine secretion or by changes in expression of activation markers like for an example CD107a, etc. For NK cells, increases in proliferation, cytotoxicity (ability to kill target cells and increases CD107a, granzyme, and perforin expression), cytokine production (e.g., IFNγ and TNF), and cell surface receptor expression (e.g. CD25) would be indicative of immune modulation that would be consistent with enhanced killing of cancer cells.

In one embodiment, γδ T cell activation is measured for example by cytokine secretion or by proliferation or by changes in expression of activation markers.

In one embodiment, Th1 cell activation is measured for example by cytokine secretion or by changes in expression of activation markers.

Appropriate increases in activity or response (or decreases, as appropriate as outlined above), are increases of 10%, 20%, 30%, 40%, 50%, 60%, 70%, 80%, 90%, 95% or 98 to 99% percent over the signal in either a reference sample or in control samples, for example test samples that do not contain an IL-12 heterodimeric fusion protein of the invention. Similarly, increases of at least one-, two-, three-, four- or five-fold as compared to reference or control samples show efficacy.

XI. Checkpoint Blockade Antibodies

In some embodiments, the IL-12-Fc fusion proteins described herein are combined with other therapeutic agents including checkpoint blockade antibodies, such as but not limited to, a PD-1 inhibitor, a TIM3 inhibitor, a CTLA4 inhibitor, a PD-L1 inhibitor, a TIGIT inhibitor, a LAG3 inhibitor, or a combination thereof. In some embodiments, the IL-12-Fc fusion proteins described herein are administered to a subject before a checkpoint blockade antibody is administered. In some embodiments, the IL-12-Fc fusion proteins described herein are administered to a subject after a checkpoint blockade antibody is administered. In some cases, any of the IL-12-Fc fusion proteins and checkpoint blockade antibodies are administered simultaneously or sequentially.

A. Anti-PD-1 Antibodies

In some embodiments, an IL-12-Fc fusion protein described herein can be administered to a subject with cancer in combination with a checkpoint blockage antibody, e.g., an anti-PD-1 antibody. In some cases, the anti-PD-1 antibody includes XENP16432 (a bivalent anti-PD-1 mAb, a checkpoint inhibitor which enhances anti-tumor activity by de-repressing the engrafted human T cells; sequences depicted in FIG. 53).

Exemplary non-limiting anti-PD-1 antibody molecules are disclosed in US 2015/0210769, published on Jul. 30, 2015, entitled "Antibody Molecules to PD-1 and Uses Thereof," incorporated by reference in its entirety.

In one embodiment, the anti-PD-1 antibody molecule includes at least one or two heavy chain variable domain (optionally including a constant region), at least one or two light chain variable domain (optionally including a constant region), or both, comprising the amino acid sequence of BAP049-Clone-A, BAP049-Clone-B, BAP049-Clone-C, BAP049-Clone-D, or BAP049-Clone-E; or as described in Table 1 of US 2015/0210769, or encoded by the nucleotide sequence in Table 1; or a sequence substantially identical (e.g., at least 80%, 85%, 90%, 92%, 95%, 97%, 98%, 99% or higher identical) to any of the aforesaid sequences. The anti-PD-1 antibody molecule, optionally, comprises a leader sequence from a heavy chain, a light chain, or both, as shown in Table 4 of US 2015/0210769; or a sequence substantially identical thereto.

In yet another embodiment, the anti-PD-1 antibody molecule includes at least one, two, or three complementarity determining regions (CDRs) from a heavy chain variable region and/or a light chain variable region of an antibody described herein, e.g., an antibody chosen from any of BAP049-hum01, BAP049-hum02, BAP049-hum03, BAP049-hum04, BAP049-hum05, BAP049-hum06, BAP049-hum07, BAP049-hum08, BAP049-hum09, BAP049-hum10, BAP049-hum11, BAP049-hum12, BAP049-hum13, BAP049-hum14, BAP049-hum15, BAP049-hum16, BAP049-Clone-A, BAP049-Clone-B, BAP049-Clone-C, BAP049-Clone-D, or BAP049-Clone-E; or as described in Table 1, or encoded by the nucleotide sequence in Table 1; or a sequence substantially identical (e.g., at least 80%, 85%, 90%, 92%, 95%, 97%, 98%, 99% or higher identical) to any of the aforesaid sequences.

In yet another embodiment, the anti-PD-1 antibody molecule includes at least one, two, or three CDRs (or collectively all of the CDRs) from a heavy chain variable region comprising an amino acid sequence shown in Table 1 of US 2015/0210769, or encoded by a nucleotide sequence shown in Table 1. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1.

In yet another embodiment, the anti-PD-1 antibody molecule includes at least one, two, or three CDRs (or collectively all of the CDRs) from a light chain variable region comprising an amino acid sequence shown in Table 1 of US 2015/0210769, or encoded by a nucleotide sequence shown in Table 1. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1. In certain embodiments, the anti-PD-1 antibody molecule includes a substitution in a light chain CDR, e.g., one or more substitutions in a CDR1, CDR2 and/or CDR3 of the light chain. In one embodiment, the anti-PD-1 antibody molecule includes a substitution in the light chain CDR3 at position 102 of the light variable region, e.g., a substitution of a cysteine to tyrosine, or a cysteine to serine residue, at position 102 of the light variable region according to Table 1 (e.g., SEQ ID NO: 16 or 24 for murine or chimeric, unmodified; or any of SEQ ID NOs: 34, 42, 46, 54, 58, 62, 66, 70, 74, or 78 for a modified sequence).

In another embodiment, the anti-PD-1 antibody molecule includes at least one, two, three, four, five or six CDRs (or collectively all of the CDRs) from a heavy and light chain variable region comprising an amino acid sequence shown in Table 1 of US 2015/0210769, or encoded by a nucleotide sequence shown in Table 1. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1.

In one embodiment, the anti-PD-1 antibody molecule includes:
(a) a heavy chain variable region (VH) comprising a VHCDR1 amino acid sequence of SEQ ID NO: 4, a VHCDR2 amino acid sequence of SEQ ID NO: 5, and a VHCDR3 amino acid sequence of SEQ ID NO: 3; and a light chain variable region (VL) comprising a VLCDR1 amino acid sequence of SEQ ID NO: 13, a VLCDR2 amino acid sequence of SEQ ID NO: 14, and a VLCDR3 amino acid sequence of SEQ ID NO: 33, each disclosed in Table 1 of US 2015/0210769;
(b) a VH comprising a VHCDR1 amino acid sequence chosen from SEQ ID NO: 1; a VHCDR2 amino acid sequence of SEQ ID NO: 2; and a VHCDR3 amino acid sequence of SEQ ID NO: 3; and a VL comprising a VLCDR1 amino acid sequence of SEQ ID NO: 10, a VLCDR2 amino acid sequence of SEQ ID NO: 11, and a VLCDR3 amino acid sequence of SEQ ID NO: 32, each disclosed in Table 1 of US 2015/0210769;
(c) a VH comprising a VHCDR1 amino acid sequence of SEQ ID NO: 224, a VHCDR2 amino acid sequence of SEQ ID NO: 5, and a VHCDR3 amino acid sequence of SEQ ID NO: 3; and a VL comprising a VLCDR1 amino acid sequence of SEQ ID NO: 13, a VLCDR2 amino acid sequence of SEQ ID NO: 14, and a VLCDR3 amino acid sequence of SEQ ID NO: 33, each disclosed in Table 1 of US 2015/0210769; or
(d) a VH comprising a VHCDR1 amino acid sequence of SEQ ID NO: 224; a VHCDR2 amino acid sequence of SEQ ID NO: 2; and a VHCDR3 amino acid sequence of SEQ ID NO: 3; and a VL comprising a VLCDR1 amino acid sequence of SEQ ID NO: 10, a VLCDR2 amino acid sequence of SEQ ID NO: 11, and a VLCDR3 amino acid sequence of SEQ ID NO: 32, each disclosed in Table 1 of US 2015/0210769.

In another embodiment, the anti-PD-1 antibody molecule comprises (i) a heavy chain variable region (VH) comprising a VHCDR1 amino acid sequence chosen from SEQ ID NO: 1, SEQ ID NO: 4, or SEQ ID NO: 224; a VHCDR2 amino acid sequence of SEQ ID NO: 2 or SEQ ID NO: 5; and a VHCDR3 amino acid sequence of SEQ ID NO: 3; and (ii) a light chain variable region (VL) comprising a VLCDR1 amino acid sequence of SEQ ID NO: 10 or SEQ ID NO: 13, a VLCDR2 amino acid sequence of SEQ ID NO: 11 or SEQ ID NO: 14, and a VLCDR3 amino acid sequence of SEQ ID NO: 32 or SEQ ID NO: 33, each disclosed in Table 1 of US 2015/0210769.

In other embodiments, the PD-1 inhibitor is an anti-PD-1 antibody chosen from nivolumab, pembrolizumab, or pidilizumab.

In some embodiments, the anti-PD-1 antibody is nivolumab. Alternative names for nivolumab include MDX-1106, MDX-1106-04, ONO-4538, or BMS-936558. In some embodiments, the anti-PD-1 antibody is Nivolumab (CAS Registry Number: 946414-94-4). Nivolumab is a fully human IgG4 monoclonal antibody which specifically blocks PD1. Nivolumab (clone 5C4) and other human monoclonal antibodies that specifically bind to PD1 are disclosed in U.S. Pat. No. 8,008,449 and WO2006/121168. In one embodiment, the inhibitor of PD-1 is nivolumab, and having a sequence disclosed herein (or a sequence substantially identical or similar thereto, e.g., a sequence at least 85%, 90%, 95% identical or higher to the sequence specified). In some embodiments, the anti-PD-1 antibody is pembrolizumab. Pembrolizumab (also referred to as lambrolizumab, MK-3475, MK03475, SCH-900475 or KEYTRUDA®; Merck) is a humanized IgG4 monoclonal antibody that binds to PD-1. Pembrolizumab and other humanized anti-PD-1 antibodies are disclosed in Hamid, O. et al. (2013) New England Journal of Medicine 369 (2): 134-44, U.S. Pat. No. 8,354,509 and WO2009/114335.

In one embodiment, the inhibitor of PD-1 is pembrolizumab disclosed in, e.g., U.S. Pat. No. 8,354,509 and WO 2009/114335, and having a sequence disclosed herein (or a sequence substantially identical or similar thereto, e.g., a sequence at least 85%, 90%, 95% identical or higher to the sequence specified).

In some embodiments, the anti-PD-1 antibody is pidilizumab. Pidilizumab (CT-011; Cure Tech) is a humanized IgG1k monoclonal antibody that binds to PD1. Pidilizumab and other humanized anti-PD-1 monoclonal antibodies are disclosed in U.S. Pat. No. 8,747,847 and WO2009/101611.

Other anti-PD-1 antibodies include AMP 514 (Amplimmune), among others, e.g., anti-PD-1 antibodies disclosed in U.S. Pat. No. 8,609,089, US 2010028330, and/or US 20120114649.

In some embodiments, the PD-1 inhibitor is an immunoadhesin (e.g., an immunoadhesin comprising an extracellular or PD-1 binding portion of PD-L1 or PD-L2 fused to a constant region (e.g., an Fc region of an immunoglobulin sequence). In some embodiments, the PD-1 inhibitor is AMP-224 (B7-DCIg; Amplimmune; e.g., disclosed in WO2010/027827 and WO2011/066342), is a PD-L2 Fc fusion soluble receptor that blocks the interaction between PD-1 and B7-H1.

In some embodiments, anti-PD-1 antibodies can be used in combination with an IL-12 Fc fusion protein of the invention. There are several anti-PD-1 antibodies including, but not limited to, two currently FDA approved antibodies, pembrolizumab and nivolizumab, as well as those in clinical testing currently, including, but not limited to, tislelizumab, Sym021, REGN2810 (developed by Rengeneron), JNJ-63723283 (developed by J and J), SHR-1210, pidilizumab, AMP-224, MEDIo680, PDR001 and CT-001, as well as others outlined in Liu et al., J. Hemat. & Oncol. (2017) 10:136, the antibodies therein expressly incorporated by reference.

In some embodiments, an IL-12-Fc fusion protein described herein can be used in combination with a PD-1 inhibitor (e.g., an anti-PD-1 antibody). In certain embodiments, an IL-12-Fc fusion protein (e.g., any XENP sequence described herein) described herein is administered in combination with an anti-PD-1 antibody.

B. Anti-TIM3 Antibodies

Exemplary non-limiting anti-TIM-3 antibody molecules are disclosed in US 2015/0218274, published on Aug. 6, 2015, entitled "Antibody Molecules to TIM-3 and Uses Thereof," incorporated by reference in its entirety.

In one embodiment, the anti-TIM-3 antibody molecule includes at least one or two heavy chain variable domain (optionally including a constant region), at least one or two light chain variable domain (optionally including a constant region), or both, comprising the amino acid sequence of ABTIM3, ABTIM3-hum01, ABTIM3-hum02, ABTIM3-hum03, ABTIM3-hum04, ABTIM3-hum05, ABTIM3-hum06, ABTIM3-hum07, ABTIM3-hum08, ABTIM3-hum09, ABTIM3-hum10, ABTIM3-hum11, ABTIM3-hum12, ABTIM3-hum13, ABTIM3-hum14, ABTIM3-hum15, ABTIM3-hum16, ABTIM3-hum17, ABTIM3-hum18, ABTIM3-hum19, ABTIM3-hum20, ABTIM3-hum21, ABTIM3-hum22, ABTIM3-hum23; or as described in Tables 1-4 of US 2015/0218274; or encoded by the nucleotide sequence in Tables 1-4; or a sequence substantially identical (e.g., at least 80%, 85%, 90%, 92%, 95%, 97%, 98%, 99% or higher identical) to any of the aforesaid sequences. The anti-TIM-3 antibody molecule, optionally, comprises a leader sequence from a heavy chain, a light chain, or both, as shown in US 2015/0218274; or a sequence substantially identical thereto.

In yet another embodiment, the anti-TIM-3 antibody molecule includes at least one, two, or three complementarity determining regions (CDRs) from a heavy chain variable region and/or a light chain variable region of an antibody described herein, e.g., an antibody chosen from any of ABTIM3, ABTIM3-hum01, ABTIM3-hum02, ABTIM3-hum03, ABTIM3-hum04, ABTIM3-hum05, ABTIM3-hum06, ABTIM3-hum07, ABTIM3-hum08, ABTIM3-hum09, ABTIM3-hum10, ABTIM3-hum11, ABTIM3-hum12, ABTIM3-hum13, ABTIM3-hum14, ABTIM3-hum15, ABTIM3-hum16, ABTIM3-hum17, ABTIM3-hum18, ABTIM3-hum19, ABTIM3-hum20, ABTIM3-hum21, ABTIM3-hum22, ABTIM3-hum23; or as described in Tables 1-4 of US 2015/0218274; or encoded by the nucleotide sequence in Tables 1-4; or a sequence substantially identical (e.g., at least 80%, 85%, 90%, 92%, 95%, 97%, 98%, 99% or higher identical) to any of the aforesaid sequences.

In yet another embodiment, the anti-TIM-3 antibody molecule includes at least one, two, or three CDRs (or collectively all of the CDRs) from a heavy chain variable region comprising an amino acid sequence shown in Tables 1-4 of US 2015/0218274, or encoded by a nucleotide sequence shown in Tables 1-2. In one embodiment, one or more of the CDRs (or collectively all of the CDRs) have one, two, three, four, five, six or more changes, e.g., amino acid substitutions or deletions, relative to the amino acid sequence shown in Tables 1-2, or encoded by a nucleotide sequence shown in Table 1-2.

In yet another embodiment, the anti-TIM-3 antibody molecule includes at least one, two, or three CDRs (or collectively all of the CDRs) from a light chain variable region comprising an amino acid sequence shown in Tables 1-4 of US 2015/0218274, or encoded by a nucleotide sequence shown in Tables 1-2. In one embodiment, one or more of the CDRs (or collectively all of the CDRs) have one, two, three, four, five, six or more changes, e.g., amino acid substitutions or deletions, relative to the amino acid sequence shown in Tables 1-2, or encoded by a nucleotide sequence shown in Tables 1-2. In certain embodiments, the anti-TIM-3 antibody molecule includes a substitution in a light chain CDR, e.g., one or more substitutions in a CDR1, CDR2 and/or CDR3 of the light chain.

In another embodiment, the anti-TIM-3 antibody molecule includes at least one, two, three, four, five or six CDRs (or collectively all of the CDRs) from a heavy and light chain variable region comprising an amino acid sequence shown in Tables 1-4 of US 2015/0218274, or encoded by a nucleotide sequence shown in Tables 1-2. In one embodiment, one or more of the CDRs (or collectively all of the CDRs) have one, two, three, four, five or more changes, e.g., amino acid substitutions or deletions, relative to the amino acid sequence shown in Tables 1-2, or encoded by a nucleotide sequence shown in Tables 1-2.

In one embodiment, the anti-TIM-3 antibody molecule includes:

(a) a heavy chain variable region (VH) comprising a VHCDR1 amino acid sequence chosen from SEQ ID NO: 9; a VHCDR2 amino acid sequence of SEQ ID NO: 10; and a VHCDR3 amino acid sequence of SEQ ID NO: 5; and a light chain variable region (VL) comprising a VLCDR1 amino acid sequence of SEQ ID NO: 12, a VLCDR2 amino acid sequence of SEQ ID NO: 13, and a VLCDR3 amino acid sequence of SEQ ID NO: 14, each disclosed in Tables 1-4 of US 2015/0218274;

(b) a VH comprising a VHCDR1 amino acid sequence chosen from SEQ ID NO: 3; a VHCDR2 amino acid sequence of SEQ ID NO: 4; and a VHCDR3 amino acid sequence of SEQ ID NO: 5; and a VL comprising a VLCDR1 amino acid sequence of SEQ ID NO: 6, a VLCDR2 amino acid sequence of SEQ ID NO: 7, and a VLCDR3 amino acid sequence of SEQ ID NO: 8, each disclosed in Tables 1-4 of US 2015/0218274;

(c) a VH comprising a VHCDR1 amino acid sequence chosen from SEQ ID NO: 9; a VHCDR2 amino acid sequence of SEQ ID NO: 25; and a VHCDR3 amino acid sequence of SEQ ID NO: 5; and a VL comprising a VLCDR1 amino acid sequence of SEQ ID NO: 12, a VLCDR2 amino acid sequence of SEQ ID NO: 13, and a VLCDR3 amino acid sequence of SEQ ID NO: 14, each disclosed in Tables 1-4 of US 2015/0218274;

(d) a VH comprising a VHCDR1 amino acid sequence chosen from SEQ ID NO: 3; a VHCDR2 amino acid sequence of SEQ ID NO: 24; and a VHCDR3 amino acid sequence of SEQ ID NO: 5; and a VL comprising a VLCDR1 amino acid sequence of SEQ ID NO: 6, a VLCDR2 amino acid sequence of SEQ ID NO: 7, and a VLCDR3 amino acid sequence of SEQ ID NO: 8, each disclosed in Tables 1-4 of US 2015/0218274;

(e) a VH comprising a VHCDR1 amino acid sequence chosen from SEQ ID NO: 9; a VHCDR2 amino acid sequence of SEQ ID NO: 31; and a VHCDR3 amino acid sequence of SEQ ID NO: 5; and a VL comprising a VLCDR1 amino acid sequence of SEQ ID NO: 12, a VLCDR2 amino acid sequence of SEQ ID NO: 13, and a VLCDR3 amino acid sequence of SEQ ID NO: 14, each disclosed in Tables 1-4 of US 2015/0218274; or (f) a VH comprising a VHCDR1 amino acid sequence chosen from SEQ ID NO: 3; a VHCDR2 amino acid sequence of SEQ ID NO: 30; and a VHCDR3 amino acid sequence of SEQ ID NO: 5; and a VL comprising a VLCDR1 amino acid sequence of SEQ ID NO: 6, a VLCDR2 amino acid sequence of SEQ ID NO: 7, and a VLCDR3 amino acid sequence of SEQ ID NO: 8, each disclosed in Tables 1-4 of US 2015/0218274.

Exemplary anti-TIM-3 antibodies are disclosed in U.S. Pat. No. 8,552,156, WO 2011/155607, EP 2581113 and U.S. Publication No.: 2014/044728.

In some embodiments, anti-TIM-3 antibodies can be used in combination an IL-12 Fc fusion protein of the invention. There are several TIM-3 antibodies in clinical development, including, but not limited to, MBG453 and TSR-022.

In some embodiments, an IL-12-Fc fusion protein described herein can be used in combination with a TIM-3 inhibitor (e.g., an anti-TIM3 antibody). In certain embodiments, an IL-12 Fc fusion protein (e.g., any XENP sequence described herein) described herein is administered in combination with an anti-TIM3 antibody.

C. Anti-CTLA4 Antibodies

Exemplary anti-CTLA4 antibodies include tremelimumab (IgG2 monoclonal antibody available from Pfizer, formerly known as ticilimumab, CP-675,206); and ipilimumab (CTLA-4 antibody, also known as MDX-010, CAS No. 477202-00-9). Other exemplary anti-CTLA-4 antibodies are disclosed, e.g., in U.S. Pat. No. 5,811,097.

In one embodiment, the anti-CTLA4 antibody is ipilimumab disclosed in, e.g., U.S. Pat. Nos. 5,811,097, 7,605,238, WO00/32231 and WO97/20574, and having a sequence disclosed herein (or a sequence substantially identical or similar thereto, e.g., a sequence at least 85%, 90%, 95% identical or higher to the sequence specified).

In one embodiment, the anti-CTLA4 antibody is tremelimumab disclosed in, e.g., U.S. Pat. No. 6,682,736 and WO00/37504, and having a sequence disclosed herein (or a sequence substantially identical or similar thereto, e.g., a sequence at least 85%, 90%, 95% identical or higher to the sequence specified).

In some embodiments, anti-CTLA-4 antibodies can be used in combination with an IL-12-Fc fusion protein of the invention. Thus, suitable anti-CTLA-4 antibodies for use in combination therapies as outlined herein include, but are not limited to, one currently FDA approved antibody ipilimumab, and several more in development, including CP-675, 206 and AGEN-1884.

In some embodiments, an IL-12-Fc fusion protein described herein can be used in combination with a CTLA-4 inhibitor (e.g., an anti-CTLA-4 antibody). In certain embodiments, an IL-12-Fc fusion proteins (e.g., any XENP sequence described herein) described herein is administered in combination with an anti-CTLA-4 antibody.

D. Anti-PD-L1 Antibodies

Exemplary non-limiting anti-PD-L1 antibody molecules are disclosed in US 2016/0108123, published on Apr. 21, 2016, entitled "Antibody Molecules to PD-L1 and Uses Thereof," incorporated by reference in its entirety.

In one embodiment, the anti-PD-L1 antibody molecule includes at least one or two heavy chain variable domain (optionally including a constant region), at least one or two light chain variable domain (optionally including a constant region), or both, comprising the amino acid sequence of any of BAP058-hum01, BAP058-hum02, BAP058-hum03, BAP058-hum04, BAP058-hum05, BAP058-hum06, BAP058-hum07, BAP058-hum08, BAP058-hum09, BAP058-hum10, BAP058-hum11, BAP058-hum12, BAP058-hum13, BAP058-hum14, BAP058-hum15, BAP058-hum16, BAP058-hum17, BAP058-Clone-K, BAP058-Clone-L, BAP058-Clone-M, BAP058-Clone-N, or BAP058-Clone-0; or as described in Table 1 of US 2016/0108123, or encoded by the nucleotide sequence in Table 1; or a sequence substantially identical (e.g., at least 80%, 85%, 90%, 92%, 95%, 97%, 98%, 99% or higher identical) to any of the aforesaid sequences.

In yet another embodiment, the anti-PD-L1 antibody molecule includes at least one, two, or three complementarity determining regions (CDRs) from a heavy chain variable region and/or a light chain variable region of an antibody described herein, e.g., an antibody chosen from any of BAP058-hum01, BAP058-hum02, BAP058-hum03, BAP058-hum04, BAP058-hum05, BAP058-hum06, BAP058-hum07, BAP058-hum08, BAP058-hum09, BAP058-hum10, BAP058-hum11, BAP058-hum12, BAP058-hum13, BAP058-hum14, BAP058-hum15, BAP058-hum16, BAP058-hum17, BAP058-Clone-K, BAP058-Clone-L, BAP058-Clone-M, BAP058-Clone-N, or BAP058-Clone-0; or as described in Table 1 of US 2016/0108123, or encoded by the nucleotide sequence in Table 1; or a sequence substantially identical (e.g., at least 80%, 85%, 90%, 92%, 95%, 97%, 98%, 99% or higher identical) to any of the aforesaid sequences.

In yet another embodiment, the anti-PD-L1 antibody molecule includes at least one, two, or three CDRs (or collectively all of the CDRs) from a heavy chain variable region comprising an amino acid sequence shown in Table 1 of US 2016/0108123, or encoded by a nucleotide sequence shown in Table 1. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1.

In yet another embodiment, the anti-PD-L1 antibody molecule includes at least one, two, or three CDRs (or collectively all of the CDRs) from a light chain variable region comprising an amino acid sequence shown in Table 1 of US 2016/0108123, or encoded by a nucleotide sequence shown in Table 1. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1. In certain embodiments, the anti-PD-L1 antibody molecule includes a substitution in a light chain CDR, e.g., one or more substitutions in a CDR1, CDR2 and/or CDR3 of the light chain.

In another embodiment, the anti-PD-L1 antibody molecule includes at least one, two, three, four, five or six CDRs (or collectively all of the CDRs) from a heavy and light chain variable region comprising an amino acid sequence shown in Table 1, or encoded by a nucleotide sequence shown in Table 1 of US 2016/0108123. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1.

In one embodiment, the anti-PD-L1 antibody molecule includes:
(i) a heavy chain variable region (VH) including a VHCDR1 amino acid sequence chosen from SEQ ID NO: 1, SEQ ID NO: 4 or SEQ ID NO: 195; a VHCDR2 amino acid sequence of SEQ ID NO: 2; and a VHCDR3 amino acid sequence of SEQ ID NO: 3, each disclosed in Table 1 of US 2016/0108123; and
(ii) a light chain variable region (VL) including a VLCDR1 amino acid sequence of SEQ ID NO: 9, a VLCDR2 amino acid sequence of SEQ ID NO: 10, and a VLCDR3 amino acid sequence of SEQ ID NO: 11, each disclosed in Table 1 of US 2016/0108123.

In another embodiment, the anti-PD-L1 antibody molecule includes:
(i) a heavy chain variable region (VH) including a VHCDR1 amino acid sequence chosen from SEQ ID NO: 1, SEQ ID NO: 4 or SEQ ID NO: 195; a VHCDR2 amino acid sequence of SEQ ID NO: 5, and a VHCDR3 amino acid sequence of SEQ ID NO: 3, each disclosed in Table 1 of US 2016/0108123; and
(ii) a light chain variable region (VL) including a VLCDR1 amino acid sequence of SEQ ID NO: 12, a VLCDR2 amino acid sequence of SEQ ID NO: 13, and a VLCDR3 amino acid sequence of SEQ ID NO: 14, each disclosed in Table 1 of US 2016/0108123.

In one embodiment, the anti-PD-L1 antibody molecule comprises the VHCDR1 amino acid sequence of SEQ ID NO: 1. In another embodiment, the anti-PD-L1 antibody molecule comprises the VHCDR1 amino acid sequence of SEQ ID NO: 4. In yet another embodiment, the anti-PD-L1 antibody molecule comprises the VHCDR1 amino acid sequence of SEQ ID NO: 195, each disclosed in Table 1 of US 2016/0108123.

In some embodiments, the PD-L1 inhibitor is an antibody molecule. In some embodiments, the anti-PD-L1 inhibitor is chosen from YW243.55.570, MPDL3280A, MEDI-4736, MSB-0010718C, MDX-1105, atezolizumab, durbalumab, avelumab, or BMS936559.

In some embodiments, the anti-PD-L1 antibody is atezolizumab. Atezolizumab (also referred to as MPDL3280A and Atezo®; Roche) is a monoclonal antibody that binds to PD-L1. Atezolizumab and other humanized anti-PD-L1 antibodies are disclosed in U.S. Pat. No. 8,217,149, and having a sequence disclosed herein (or a sequence substantially identical or similar thereto, e.g., a sequence at least 85%, 90%, 95% identical or higher to the sequence specified).

In some embodiments, the anti-PD-L1 antibody is avelumab. Avelumab (also referred to as A09-246-2; Merck Serono) is a monoclonal antibody that binds to PD-L1. Avelumab and other humanized anti-PD-L1 antibodies are disclosed in U.S. Pat. No. 9,324,298 and WO2013/079174, and having a sequence disclosed herein (or a sequence substantially identical or similar thereto, e.g., a sequence at least 85%, 90%, 95% identical or higher to the sequence specified).

In some embodiments, the anti-PD-L1 antibody is durvalumab. Durvalumab (also referred to as MEDI4736; AstraZeneca) is a monoclonal antibody that binds to PD-L1. Durvalumab and other humanized anti-PD-L1 antibodies are disclosed in U.S. Pat. No. 8,779,108, and having a sequence disclosed herein (or a sequence substantially identical or similar thereto, e.g., a sequence at least 85%, 90%, 95% identical or higher to the sequence specified).

In some embodiments, the anti-PD-L1 antibody is BMS-936559. BMS-936559 (also referred to as MDX-1105; BMS) is a monoclonal antibody that binds to PD-L1. BMS-936559 and other humanized anti-PD-L1 antibodies are disclosed in U.S. Pat. No. 7,943,743 and WO2007005874, and having a sequence disclosed herein (or a sequence substantially identical or similar thereto, e.g., a sequence at least 85%, 90%, 95% identical or higher to the sequence specified).

In some embodiments, anti-PD-L1 antibodies can be used in combination with an IL-12-Fc fusion protein of the invention. There are several anti-PD-L1 antibodies including three currently FDA approved antibodies, atezolizumab, avelumab, durvalumab, as well as those in clinical testing currently, including, but not limited to, LY33000054 and CS1001, as well as others outlined in Liu et al., J. Hemat. & Oncol. (2017) 10:136, the antibodies therein expressly incorporated by reference.

In some embodiments, an IL-12-Fc fusion protein described herein can be used in combination with a PD-L1 or PD-L2 inhibitor (e.g., an anti-PD-L1 antibody).

E. Anti-TIGIT Antibodies

In some embodiments, the anti-TIGIT antibody is OMP-313M32. OMP-313M32 (OncoMed Pharmaceuticals) is a monoclonal antibody that binds to TIGIT. OMP-313M32 and other humanized anti-TIGIT antibodies are disclosed in US20160376365 and WO2016191643, and having a sequence disclosed herein (or a sequence substantially identical or similar thereto, e.g., a sequence at least 85%, 90%, 95% identical or higher to the sequence specified).

In some embodiments, the anti-TIGIT antibody is BMS-986207. BMS-986207 (also referred to as ONO-4686; Bristol-Myers Squibb) is a monoclonal antibody that binds to TIGIT. BMS-986207 and other humanized anti-TIGIT antibodies are disclosed in US20160176963 and WO2016106302, and having a sequence disclosed herein (or a sequence substantially identical or similar thereto, e.g., a sequence at least 85%, 90%, 95% identical or higher to the sequence specified).

In some embodiments, the anti-TIGIT antibody is MTIG7192. MTIG7192 (Genentech) is a monoclonal antibody that binds to TIGIT. MTIG7192 and other humanized anti-TIGIT antibodies are disclosed in US2017088613, WO2017053748, and WO2016011264, and having a sequence disclosed herein (or a sequence substantially identical or similar thereto, e.g., a sequence at least 85%, 90%, 95% identical or higher to the sequence specified).

In some embodiments, anti-TIGIT antibodies can be used in combination with an IL-12-Fc fusion protein of the invention. There are several TIGIT antibodies in clinical development, BMS-986207, OMP-313M32 and MTIG7192A.

In some embodiments, an IL-12-Fc fusion protein described herein can be used in combination with a TIGIT inhibitor (e.g., an anti-TIGIT antibody). In certain embodiments, an IL-12-Fc fusion protein (e.g., any XENP sequence described herein) described herein is administered in combination with an anti-TIGIT antibody.

F. Anti-LAG3 Antibodies

Exemplary non-limiting anti-LAG-3 antibody molecules are disclosed in US 2015/0259420 published on Sep. 17, 2015, entitled "Antibody Molecules to LAG-3 and Uses Thereof," incorporated by reference in its entirety.

In one embodiment, the anti-LAG-3 antibody molecule includes at least one or two heavy chain variable domain (optionally including a constant region), at least one or two light chain variable domain (optionally including a constant region), or both, comprising the amino acid sequence of any of BAP050-hum01, BAP050-hum02, BAP050-hum03, BAP050-hum04, BAP050-hum05, BAP050-hum06, BAP050-hum07, BAP050-hum08, BAP050-hum09, BAP050-hum10, BAP050-hum11, BAP050-hum12, BAP050-hum13, BAP050-hum14, BAP050-hum15, BAP050-hum16, BAP050-hum17, BAP050-hum18, BAP050-hum19, BAP050-hum20, huBAP050(Ser) (e.g., BAP050-hum01-Ser, BAP050-hum02-Ser, BAP050-hum03-Ser, BAP050-hum04-Ser, BAP050-hum05-Ser, BAP050-hum06-Ser, BAP050-hum07-Ser, BAP050-hum08-Ser, BAP050-hum09-Ser, BAP050-hum10-Ser, BAP050-hum11-Ser, BAP050-hum12-Ser, BAP050-hum13-Ser, BAP050-hum14-Ser, BAP050-hum15-Ser, BAP050-hum18-Ser, BAP050-hum19-Ser, or BAP050-hum20-Ser), BAP050-Clone-F, BAP050-Clone-G, BAP050-Clone-H, BAP050-Clone-I, or BAP050-Clone-J; or as described in Table 1 of US 2015/0259420, or encoded by the nucleotide sequence in Table 1; or a sequence substantially identical (e.g., at least 80%, 85%, 90%, 92%, 95%, 97%, 98%, 99% or higher identical) to any of the aforesaid sequences.

In yet another embodiment, the anti-LAG-3 antibody molecule includes at least one, two, or three complementarity determining regions (CDRs) from a heavy chain variable region and/or a light chain variable region of an antibody described herein, e.g., an antibody chosen from any of BAP050-hum01, BAP050-hum02, BAP050-hum03, BAP050-hum04, BAP050-hum05, BAP050-hum06, BAP050-hum07, BAP050-hum08, BAP050-hum09, BAP050-hum10, BAP050-hum11, BAP050-hum12, BAP050-hum13, BAP050-hum14, BAP050-hum15, BAP050-hum16, BAP050-hum17, BAP050-hum18, BAP050-hum19, BAP050-hum20, huBAP050(Ser) (e.g., BAP050-hum01-Ser, BAP050-hum02-Ser, BAP050-hum03-Ser, BAP050-hum04-Ser, BAP050-hum05-Ser, BAP050-hum06-Ser, BAP050-hum07-Ser, BAP050-hum08-Ser, BAP050-hum09-Ser, BAP050-hum10-Ser, BAP050-hum11-Ser, BAP050-hum12-Ser, BAP050-hum13-Ser, BAP050-hum14-Ser, BAP050-hum15-Ser, BAP050-hum18-Ser, BAP050-hum19-Ser, or BAP050-hum20-Ser), BAP050-Clone-F, BAP050-Clone-G, BAP050-Clone-H, BAP050-Clone-I, or BAP050-Clone-J; or as described in Table 1 of US 2015/0259420, or encoded by the nucleotide sequence in Table 1; or a sequence substantially identical (e.g., at least 80%, 85%, 90%, 92%, 95%, 97%, 98%, 99% or higher identical) to any of the aforesaid sequences.

In yet another embodiment, the anti-LAG-3 antibody molecule includes at least one, two, or three CDRs (or collectively all of the CDRs) from a heavy chain variable region comprising an amino acid sequence shown in Table 1 of US 2015/0259420, or encoded by a nucleotide sequence shown in Table 1. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1.

In yet another embodiment, the anti-LAG-3 antibody molecule includes at least one, two, or three CDRs (or collectively all of the CDRs) from a light chain variable region comprising an amino acid sequence shown in Table 1 of US 2015/0259420, or encoded by a nucleotide sequence shown in Table 1. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1. In certain embodiments, the anti-PD-L1 antibody molecule includes a substitution in a light chain CDR, e.g., one or more substitutions in a CDR1, CDR2 and/or CDR3 of the light chain.

In another embodiment, the anti-LAG-3 antibody molecule includes at least one, two, three, four, five or six CDRs (or collectively all of the CDRs) from a heavy and light chain variable region comprising an amino acid sequence shown in Table 1, or encoded by a nucleotide sequence shown in Table 1 of US 2015/0259420. In one embodiment, one or more of the CDRs (or collectively all of the CDRs) have one, two, three, four, five, six or more changes, e.g., amino acid substitutions or deletions, relative to the amino acid sequence shown in Table 1, or encoded by a nucleotide sequence shown in Table 1.

In one embodiment, the anti-LAG-3 antibody molecule includes:
  (i) a heavy chain variable region (VH) including a VHCDR1 amino acid sequence chosen from SEQ ID NO: 1, SEQ ID NO: 4 or SEQ ID NO: 286; a VHCDR2 amino acid sequence of SEQ ID NO: 2; and a VHCDR3 amino acid sequence of SEQ ID NO: 3, each disclosed in Table 1 of US 2015/0259420; and
  (ii) a light chain variable region (VL) including a VLCDR1 amino acid sequence of SEQ ID NO: 10, a VLCDR2 amino acid sequence of SEQ ID NO: 11, and a VLCDR3 amino acid sequence of SEQ ID NO: 12, each disclosed in Table 1 of US 2015/0259420.

In another embodiment, the anti-LAG-3 antibody molecule includes:
  (i) a heavy chain variable region (VH) including a VHCDR1 amino acid sequence chosen from SEQ ID NO: 1, SEQ ID NO: 4 or SEQ ID NO: 286; a VHCDR2 amino acid sequence of SEQ ID NO: 5, and a VHCDR3 amino acid sequence of SEQ ID NO: 3, each disclosed in Table 1 of US 2015/0259420; and
  (ii) a light chain variable region (VL) including a VLCDR1 amino acid sequence of SEQ ID NO: 13, a VLCDR2 amino acid sequence of SEQ ID NO: 14, and a VLCDR3 amino acid sequence of SEQ ID NO: 15, each disclosed in Table 1 of US 2015/0259420.

In one embodiment, the anti-LAG-3 antibody molecule comprises the VHCDR1 amino acid sequence of SEQ ID NO: 1. In another embodiment, the anti-LAG-3 antibody molecule comprises the VHCDR1 amino acid sequence of SEQ ID NO: 4. In yet another embodiment, the anti-LAG-3 antibody molecule comprises the VHCDR1 amino acid sequence of SEQ ID NO: 286, each disclosed in Table 1 of US 2015/0259420.

In some embodiments, the anti-LAG-3 antibody is BMS-986016. BMS-986016 (also referred to as BMS986016; Bristol-Myers Squibb) is a monoclonal antibody that binds to LAG-3. BMS-986016 and other humanized anti-LAG-3 antibodies are disclosed in US 2011/0150892, WO2010/019570, and WO2014/008218.

In some embodiments, the anti-LAG3 antibody is LAG525. LAG525 (also referred to as IMP701; Novartis) is a monoclonal antibody that binds to LAG3. LAG525 and other humanized anti-LAG3 antibodies are disclosed in U.S. Pat. No. 9,244,059 and WO2008132601, and having a sequence disclosed herein (or a sequence substantially identical or similar thereto, e.g., a sequence at least 85%, 90%, 95% identical or higher to the sequence specified).

Other exemplary anti-LAG3 antibodies are disclosed, e.g., in US2011150892 and US2018066054.

In some embodiments, anti-LAG-3 antibodies can be used in combination with an IL-12-Fc fusion protein of the invention. There are several anti-LAG-3 antibodies in clinical development including REGN3767, by Regeneron and TSR-033 (Tesaro).

In some embodiments, an IL-12-Fc fusion protein described herein can be used in combination with a LAG3 inhibitor (e.g., an anti-LAG3 antibody). In certain embodiments, an IL-12-Fc fusion protein (e.g., any XENP sequence described herein) described herein is administered in combination with an anti-LAG3 antibody.

XII. Combination Therapy

In some aspects, the IL-12-Fc fusion proteins described herein is administered in combination with another therapeutic agent. Administered "in combination", as used herein, means that two (or more) different treatments are delivered to the subject during the course of the subject's affliction with the disorder, e.g., the two or more treatments are delivered after the subject has been diagnosed with the disorder and before the disorder has been cured or eliminated or treatment has ceased for other reasons. In some embodiments, the delivery of one treatment is still occurring when the delivery of the second begins, so that there is overlap in terms of administration. This is sometimes referred to herein as "simultaneous" or "concurrent delivery". In other embodiments, the delivery of one treatment ends before the delivery of the other treatment begins. In some embodiments of either case, the treatment is more effective because of combined administration. For example, the second treatment is more effective, e.g., an equivalent effect is seen with less of the second treatment, or the second treatment reduces symptoms to a greater extent, than would be seen if the second treatment were administered in the absence of the first treatment, or the analogous situation is seen with the first treatment. In some embodiments, delivery is such that the reduction in a symptom, or other parameter related to the disorder is greater than what would be observed with one treatment delivered in the absence of the other. The effect of the two treatments can be partially additive, wholly additive, or greater than additive. The delivery can be such that an effect of the first treatment delivered is still detectable when the second is delivered.

The IL-12-Fc fusion proteins (e.g., any XENP sequence described herein) described herein and the at least one additional therapeutic agent can be administered simultaneously, in the same or in separate compositions, or sequentially. For sequential administration, the IL-12-Fc fusion proteins (e.g., any XENP sequence described herein) described herein can be administered first, and the additional agent can be administered second, or the order of administration can be reversed.

The IL-12-Fc fusion proteins (e.g., any XENP sequence described herein) described herein and/or other therapeutic agents, procedures or modalities can be administered during periods of active disorder, or during a period of remission or less active disease. The IL-12-Fc fusion proteins (e.g., any XENP sequence described herein) can be administered before the other treatment, concurrently with the treatment, post-treatment, or during remission of the disorder.

When administered in combination, the IL-12-Fc fusion protein (e.g., any XENP sequence described herein) and the additional agent (e.g., second or third agent), or all, can be administered in an amount or dose that is lower or the same than the amount or dosage of each agent used individually, e.g., as a monotherapy. In some embodiments, the administered amount or dosage of IL-12-Fc fusion protein (e.g., any XENP sequence described herein), the additional agent (e.g., second or third agent), or all, is lower (e.g., at least 20%, at least 30%, at least 40%, or at least 50%) than the amount or dosage of each agent used individually, e.g., as a monotherapy. In other embodiments, the amount or dosage of the IL-12-Fc fusion protein (e.g., any XENP sequence described herein), the additional agent (e.g., second or third agent), or all, that results in a desired effect (e.g., treatment of cancer) is lower (e.g., at least 20%, at least 30%, at least 40%, or at least 50% lower) than the amount or dosage of each agent used individually, e.g., as a monotherapy, required to achieve the same therapeutic effect.

In further aspects, an IL-12-Fc fusion protein (e.g., any XENP sequence described herein) described herein may be used in a treatment regimen in combination with chemotherapy, radiation, immunosuppressive agents, such as cyclosporin, azathioprine, methotrexate, mycophenolate, and FK506, antibodies directed against checkpoint inhibitors, or other immunoablative agents such as CAMPATH, other antibody therapies, cytoxan, fludarabine, cyclosporin, FK506, rapamycin, mycophenolic acid, steroids, FR90165, cytokines, and irradiation. peptide vaccine, such as that described in Izumoto et al. 2008 J Neurosurg 108:963-971.

In certain instances, compounds of the present invention are combined with other therapeutic agents, such as other anti-cancer agents, anti-allergic agents, anti-nausea agents (or anti-emetics), pain relievers, cytoprotective agents, and combinations thereof.

In one embodiment, an IL-12-Fc fusion protein (e.g., any XENP sequence described herein) described herein can be used in combination with a chemotherapeutic agent. Exemplary chemotherapeutic agents include an anthracycline (e.g., idarubicin, daunorubicin, doxorubicin (e.g., liposomal doxorubicin)), a anthracenedione derivative (e.g., mitoxantrone), a vinca alkaloid (e.g., vinblastine, vincristine, vindesine, vinorelbine), an alkylating agent (e.g., cyclophosphamide, dacarbazine, melphalan, ifosfamide, temozolomide), an immune cell antibody (e.g., alemtuzamab, gemtuzumab, rituximab, ofatumumab, tositumomab, brentuximab), an antimetabolite (including, e.g., folic acid antagonists, cytarabine, pyrimidine analogs, purine analogs and adenosine deaminase inhibitors (e.g., fludarabine)), an mTOR inhibitor, a TNFR glucocorticoid induced TNFR related protein (GITR) agonist, a proteasome inhibitor (e.g., aclacinomycin A, gliotoxin or bortezomib), an immunomodulator such as thalidomide or a thalidomide derivative (e.g., lenalidomide), a kinase inhibitor such as ibrutinib (e.g., Imbruvica), a corticosteroid (e.g., dexamethasone, prednisone), and CVP (a combination of cyclophosphamide, vincristine, and prednisone), CHOP (a combination of cyclophosphamide, hydroxydaunorubicin, Oncovin® (vincristine), and prednisone) with or without etoposide (e.g., VP-16), a combination of cyclophosphamide and pentostatin, a combination of chlorambucil and prednisone, a combination of fludarabine and cyclophosphamide, or another agent such as mechlorethamine hydrochloride (e.g. Mustargen), doxorubicin (Adriamycin®), methotrexate, oxaliplatin, or cytarabine (ara-C).

General chemotherapeutic agents considered for use in combination therapies include anastrozole (Arimidex®), bicalutamide (Casodex®), bleomycin sulfate (Blenoxane®), busulfan (Myleran®), busulfan injection (Busulfex®), capecitabine (Xeloda®), N4-pentoxycarbonyl-5-deoxy-5-fluorocytidine, carboplatin (Paraplatin®), carmustine (BiCNU®), chlorambucil (Leukeran®), cisplatin (Platinol®), cladribine (Leustatin®), cyclophosphamide (Cytoxan® or Neosar®), cytarabine, cytosine arabinoside (Cytosar-U®), cytarabine liposome injection (DepoCyt®), dacarbazine (DTIC-Dome®), dactinomycin (Actinomycin D, Cosmegan), daunorubicin hydrochloride (Cerubidine®), daunorubicin citrate liposome injection (DaunoXome®), dexamethasone, docetaxel (Taxotere®), doxorubicin hydrochloride (Adriamycin®, Rubex®), etoposide (Vepesid®), fludarabine phosphate (Fludara®), 5-fluorouracil (Adrucil®, Efudex®), flutamide (Eulexin®), tezacitibine, Gemcitabine (difluorodeoxycitidine), hydroxyurea (Hydrea®), Idarubicin (Idamycin®), ifosfamide (IFEX®), irinotecan (Camptosar®), L-asparaginase (ELSPAR®), leucovorin calcium, melphalan (Alkeran®), 6-mercaptopurine (Purinethol®), methotrexate (Folex®), mitoxantrone (Novantrone®), mylotarg, paclitaxel (Taxol®), phoenix (Yttrium90/MX-DTPA), pentostatin, polifeprosan 20 with carmustine implant (Gliadel®), tamoxifen citrate (Nolvadex®), teniposide (Vumon®), 6-thioguanine, thiotepa, tirapazamine (Tirazone®), topotecan hydrochloride for injection (Hycamptin®), vinblastine (Velban®), vincristine (Oncovin®), and vinorelbine (Navelbine®).

XIII. Treatments

Once made, the compositions of the invention find use in a number of oncology applications, by treating cancer, generally by promoting T cell activation (e.g., T cells are no longer suppressed) with the binding of the heterodimeric Fc fusion proteins of the invention.

Accordingly, the heterodimeric compositions of the invention find use in the treatment of these cancers.

A. Fusion Protein Compositions for In Vivo Administration

Formulations of the fusion proteins used in accordance with the present invention are prepared for storage by mixing a fusion protein having the desired degree of purity with optional pharmaceutically acceptable carriers, excipients or stabilizers (as generally outlined in Remington's Pharmaceutical Sciences 16th edition, Osol, A. Ed. [1980]), in the form of lyophilized formulations or aqueous solutions. Acceptable carriers, buffers, excipients, or stabilizers are nontoxic to recipients at the dosages and concentrations employed, and include buffers such as phosphate, citrate, and other organic acids; antioxidants including ascorbic acid and methionine; preservatives (such as octadecyldimethylbenzyl ammonium chloride; hexamethonium chloride; benzalkonium chloride, benzethonium chloride; phenol, butyl or benzyl alcohol; alkyl parabens such as methyl or propyl paraben; catechol; resorcinol; cyclohexanol; 3-pentanol; and m-cresol); low molecular weight (less than about 10 residues) polypeptides; proteins, such as serum albumin, gelatin, or immunoglobulins; hydrophilic polymers such as polyvinylpyrrolidone; amino acids such as glycine, glutamine, asparagine, histidine, arginine, or lysine; monosaccharides, disaccharides, and other carbohydrates including glucose, mannose, or dextrins; chelating agents such as EDTA; sugars such as sucrose, mannitol, trehalose or sorbitol; salt-forming counter-ions such as sodium; metal complexes (e.g. Zn-protein complexes); and/or non-ionic surfactants such as TWEEN™, PLURONICS™ or polyethylene glycol (PEG).

B. Administrative Modalities

The fusion proteins and chemotherapeutic agents of the invention are administered to a subject, in accord with known methods, such as intravenous administration as a bolus or by continuous infusion over a period of time.

C. Treatment Modalities

In the methods of the invention, therapy is used to provide a positive therapeutic response with respect to a disease or condition. By "positive therapeutic response" is intended an improvement in the disease or condition, and/or an improvement in the symptoms associated with the disease or condition. For example, a positive therapeutic response would refer to one or more of the following improvements in the disease: (1) a reduction in the number of neoplastic cells; (2) an increase in neoplastic cell death; (3) inhibition of neoplastic cell survival; (5) inhibition (i.e., slowing to some extent, preferably halting) of tumor growth; (6) an increased patient survival rate; and (7) some relief from one or more symptoms associated with the disease or condition.

Positive therapeutic responses in any given disease or condition can be determined by standardized response criteria specific to that disease or condition. Tumor response can be assessed for changes in tumor morphology (i.e., overall tumor burden, tumor size, and the like) using screening techniques such as magnetic resonance imaging (MRI) scan, x-radiographic imaging, computed tomographic (CT) scan, bone scan imaging, endoscopy, and tumor biopsy sampling including bone marrow aspiration (BMA) and counting of tumor cells in the circulation.

In addition to these positive therapeutic responses, the subject undergoing therapy may experience the beneficial effect of an improvement in the symptoms associated with the disease.

Treatment according to the present invention includes a "therapeutically effective amount" of the medicaments used. A "therapeutically effective amount" refers to an amount effective, at dosages and for periods of time necessary, to achieve a desired therapeutic result.

A therapeutically effective amount may vary according to factors such as the disease state, age, sex, and weight of the individual, and the ability of the medicaments to elicit a desired response in the individual. A therapeutically effective amount is also one in which any toxic or detrimental effects of the protein or protein portion are outweighed by the therapeutically beneficial effects.

A "therapeutically effective amount" for tumor therapy may also be measured by its ability to stabilize the progression of disease. The ability of a compound to inhibit cancer may be evaluated in an animal model system predictive of efficacy in human tumors.

Alternatively, this property of a composition may be evaluated by examining the ability of the compound to inhibit cell growth or to induce apoptosis by in vitro assays known to the skilled practitioner. A therapeutically effective amount of a therapeutic compound may decrease tumor size, or otherwise ameliorate symptoms in a subject. One of ordinary skill in the art would be able to determine such amounts based on such factors as the subject's size, the severity of the subject's symptoms, and the particular composition or route of administration selected.

Dosage regimens are adjusted to provide the optimum desired response (e.g., a therapeutic response). For example, a single bolus may be administered, several divided doses may be administered over time or the dose may be proportionally reduced or increased as indicated by the exigencies of the therapeutic situation. Parenteral compositions may be formulated in dosage unit form for ease of administration and uniformity of dosage. Dosage unit form as used herein refers to physically discrete units suited as unitary dosages for the subjects to be treated; each unit contains a predetermined quantity of active compound calculated to produce the desired therapeutic effect in association with the required pharmaceutical carrier.

The specification for the dosage unit forms of the present invention are dictated by and directly dependent on (a) the unique characteristics of the active compound and the particular therapeutic effect to be achieved, and (b) the limitations inherent in the art of compounding such an active compound for the treatment of sensitivity in individuals.

The efficient dosages and the dosage regimens for the heterodimeric proteins used in the present invention depend on the disease or condition to be treated and may be determined by the persons skilled in the art.

An exemplary, non-limiting range for a therapeutically effective amount of an heterodimeric proteins used in the present invention is about 0.1-100 mg/kg.

All cited references are herein expressly incorporated by reference in their entirety.

Whereas particular embodiments of the invention have been described above for purposes of illustration, it will be appreciated by those skilled in the art that numerous variations of the details may be made without departing from the invention as described in the appended claims.

EXAMPLES

Examples are provided below to illustrate the present invention. These examples are not meant to constrain the present invention to any particular application or theory of operation. For all constant region positions discussed in the present invention, numbering is according to the EU index as in Kabat (Kabat et al., 1991, Sequences of Proteins of Immunological Interest, 5th Ed., United States Public Health Service, National Institutes of Health, Bethesda, entirely incorporated by reference). Those skilled in the art of antibodies will appreciate that this convention consists of nonsequential numbering in specific regions of an immunoglobulin sequence, enabling a normalized reference to conserved positions in immunoglobulin families. Accordingly, the positions of any given immunoglobulin as defined by the EU index will not necessarily correspond to its sequential sequence.

General and specific scientific techniques are outlined in US Patent Publication Nos. 2015/0307629, 2014/0288275 and WO2014/145806, all of which are expressly incorporated by reference in their entirety and particularly for the techniques outlined therein.

Example 1: IL-12-Fc Fusion Proteins

As with other cytokines, IL-12 has a short half-life, and high dose treatment to overcome the short half-life results in systemic toxicity. Additionally, it has also been reported that anti-tumor effect requires sustained induction of IFNγ production by IL-12 (Gollob, J A et al., 2000). Further, the IL-12p40 subunit, as either a monomer or a homodimer, has been reported to antagonize IL-12 activity by competing for binding to IL-12 receptors (Gillessen, S et al., 1995); accordingly, it is advantageous to pre-complex the IL-12p40 and IL-12p35 subunits. In order to address these two caveats, we engineered the IL-12 heterodimer as Fc fusion proteins (collectively referred to hereon as IL-12-Fc fusions) both to enhance circulation through FcRn-mediated recycling and to pre-complex the IL-12p40 and IL-12p35 subunits.

1A: Engineering IL-12-Fc Fusions in Various Formats

We generated the N-terminal IL-12 heterodimeric Fc fusion or "IL-12-heteroFc" format which comprises the IL-12p40 subunit recombinantly fused to the N-terminus of one side of a heterodimeric Fc and the IL-12p35 subunit recombinantly fused to N-terminus of the other side of the heterodimeric Fc (FIG. 9A). The IL-12p40 and IL-12p35 subunits may be linked to their respective Fc chains by a domain linker. An illustrative protein of this format is XENP27201, sequences for which are depicted in FIG. 10.

We also generated the C-terminal IL-12 heterodimeric Fc fusion or "heteroFc-IL-12" format which comprises the IL-12p40 subunit recombinantly fused to the C-terminus of one side of a heterodimeric Fc and the IL-12p35 subunit recombinantly fused to the C-terminus of the other side of the heterodimeric Fc (FIG. 9B). The IL-12p30 and IL-12p35 subunits may be linked to their respective Fc chains by a domain linker. An illustrative protein of this format is XENP27202, sequences for which are depicted in FIG. 11.

Figure 9C:
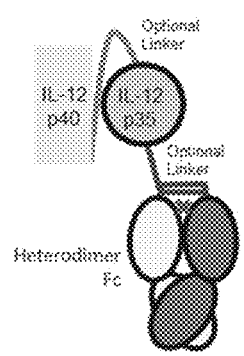
Figure 9D:
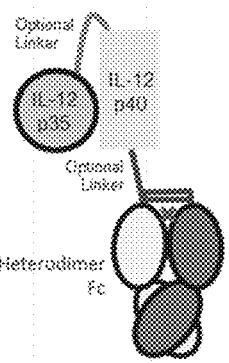
Figure 9E:
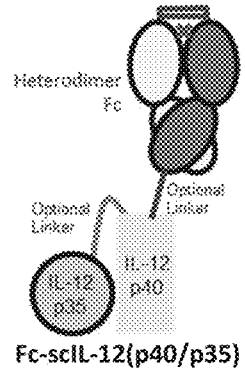
Figure 9F:
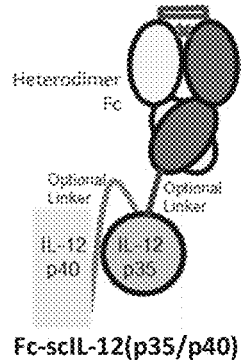

We further generated the N-terminal single-chain IL-12-Fc fusion or "scIL-12-Fc" format which comprises a single-chain IL-12 complex (or "scIL-12 complex") recombinantly fused to the N-terminus of one side of a heterodimeric Fc (optionally via a domain linker), with the other side of the molecule being a "Fc-only" or "empty-Fc" heterodimeric Fc (FIGS. 9C-9D). The scIL-12 complex can comprise either IL-12p35 N-terminally linked to IL-12p40 or IL-12p40 N-terminally linked to IL-12p35, optionally with a domain linker. The order of the two subunits in the scIL-12 complex are designated herein as follows: "scIL-12(p40/p35)", wherein the IL-12p40 subunit is N-terminally linked to the IL-12p35 subunit, or "scIL-12(p35/p40)", wherein the IL-12p35 is N-terminally linked to the IL-12p35 subunit. Illustrative proteins of the scIL-12-Fc format include XENP27203 and XENP27204, sequences for which are depicted in FIG. 12.

Cartoon schematics for additional IL-12-Fc formats contemplated for use are depicted in FIGS. 9A-9F.

1B: Production and Physical Characterization of Illustrative IL-12-Fc Fusions

1B(a): IL-12-heteroFc

Plasmids coding for the IL-12p35 and IL-12p40 subunits were constructed by standard gene synthesis, followed by subcloning into a pTT5 expression vector containing Fc fusion partners (e.g., constant regions as depicted in FIGS. 8A-8D). Proteins were produced by transient transfection in HEK293E cells and were purified by a two-step purification process comprising protein A chromatography (purification part 1) followed by anion exchange chromatography (purification part 2). Chromatogram depicting purification part 2 for illustrative IL-12-heteroFc XENP27201 is depicted in FIG. 13A. The chromatogram shows the isolation of two peaks (peak A and peak B), which were further characterized by analytical size-exclusion chromatography with multi-angle light scattering (aSEC-MALS) and analytical anion-exchange chromatography (analytical AIEX) for identity, purity and homogeneity as generally described below.

Peaks A and B isolated from purification part 2 for XENP27201 were analyzed using aSEC-MALS to deduce their component protein species. The analysis was performed on an Agilent 1200 high-performance liquid chromatography (HPLC) system. Samples were injected onto a Superdex™ 200 10/300 GL column (GE Healthcare Life Sciences) at 1.0 mL/min using 1×PBS, pH 7.4 as the mobile phase at 4° C. for 25 minutes with UV detection wavelength at 280 nM. MALS was performed on a miniDAWN® TREOS® with an Optilab® T-rEX Refractive Index Detector (Wyatt Technology, Santa Barbara, Cali.). Analysis was performed using Agilent OpenLab Chromatography Data System (CDS) ChemStation Edition AIC version C.01.07 and ASTRA version 6.1.7.15. Chromatograms depicting aSEC separation profiles for peaks A and B are depicted in FIG. 13B along with MW of component species as determined by MALS. The profiles show that peak A comprises species with molecular weights of ~299 kD and ~140 kD, while peak B primarily comprises a species with molecular weight of ~118 kD, which is consistent with the calculated molecular weight of XENP27201 (based on amino acid sequence) of 110.4 kDa taking into account additional mass contributed by glycans.

The peaks from purification part 2 were also analyzed using analytical AIEX to further assess the purity and homogeneity of peak B. The analysis was performed on an Agilent 1200 high-performance liquid chromatography (HPLC) system. Samples were injected onto a Proteomix SAX-NP5 5 µM non-porous column (Sepax Technologies, Inc., Newark, Del.) at 1.0 mL/min using 0-40% NaCl gradient in 20 mM Tris, pH 8.5 buffer with UV detection wavelength at 280 nM. Analysis was performed using Agilent OpenLAB CDS ChemStation Edition AIC version C.01.07. Chromatograms depicting analytical AIEX separation of peaks A and B are depicted in FIG. 13C. Consistent with the aSEC separation profile for peak B, the analytical AIEX separation profile for peak B illustrates the purity and homogeneity of species in peak B. From here on, XENP27201 refers to peak B as isolated from purification part 2 as depicted in FIG. 13A.

1B(b): scIL-12(p40/p35)-Fc

Plasmids coding for IL-12p40 recombinantly fused to IL-12p35 via a linker were constructed by standard gene synthesis, followed by subcloning into a pTT5 expression vector containing Fc fusion partners (e.g., constant regions as depicted in FIGS. 8A-8D). Proteins were produced by transient transfection in HEK293E cells and were purified by a two-step purification process comprising protein A chromatography (purification part 1) and anion exchange chromatography (purification part 2).

Chromatogram depicting purification part 2 for illustrative scIL-12(p40/p35)-Fc fusion XENP27203 is depicted in FIG. 14A. As above, the chromatogram shows the isolation of two peaks, which were further characterized by aSEC-MALS and analytical AIEX for identity, purity and homogeneity as described in Example 1B(a), chromatograms for which are depicted in FIG. 14B-FIG. 14C.

The aSEC separation profiles for peaks A and B isolated from purification part 2 of XENP27203 show that peak A comprises species with molecular weights of ~396 kD, ~188 kD, and ~118 kD, while peak B primarily comprises a species with molecular weight of ~118 kD, which is consistent with the calculated molecular weight of XENP27203 (based on amino acid sequence) of 111.3 kDa taking into account additional mass contributed by glycans. The peaks were also analyzed using analytical AIEX as described in Example 1B(a) to further investigate the purity and homogeneity of peak B. Consistent with the aSEC separation profile for peak B, the analytical AIEX separation profile for peak B (FIG. 14C) illustrates the purity and homogeneity of species in peak B. From here on, XENP27203 refers to peak B as isolated from anion exchange as depicted in FIG. 14A.

1C: In Vitro Activity of IL-12-Fc Fusions in Induction of STAT4 Phosphorylation

Following binding of cytokines to their receptors, Janus kinases (JAKs) associated with the cytokine receptors phosphorylate STAT proteins which then translocate into the nucleus to regulate further downstream processes. In particular, IL-12 mediates IFNγ expression and secretion through phosphorylation of STAT4 (Morinobu et al., 2002). Accordingly, the ability of the above described IL-12-heteroFc (XENP27201) and scIL-12(p40/p35)-Fc (XENP27203) to induce STAT4 phosphorylation in various lymphocyte populations was investigated. Bivalent IL-12p35-Fc fusions and IL-12p40-Fc fusions (cartoon schematics and sequences for which are depicted in FIGS. 15A-15B and FIG. 16) as well as recombinant IL-12 were used as controls.

Fresh PBMCs were activated by incubation with plate bound anti-CD3 (100 ng/ml) for 3 days. Following activation, PBMCs were then incubated with the indicated test articles at the indicated concentrations for 15 minutes at 37° C. Following incubation, PBMCs were first stained with anti-CD3-BUV395 (UCHT1), anti-CD4-BV605 (RPA-T4), anti-CD8-AF700 (SK1), anti-CD14-APC/Fire750 (M5E2), anti-CD20-PerCP/5.5 (2H7), anti-CD25-BV421 (M-A251), and anti-CD56-PE antibodies. Following the first stain, cells were permeabilized using PerFix EXPOSE (Beckman Coulter, Indianapolis, Ind.). Following permeabilization, cells were stained with anti-anti-CD45RA-BV510 (HI100), anti-FoxP3-AF488 (259D), and anti-pSTAT4-AF647 (38/p-Stat4) antibodies. Following the second staining, the cells were analyzed by flow cytometry to investigate STAT4 phosphorylation on various lymphocyte populations. Data depicting pSTAT4 MFI on various lymphocyte populations, indicating signaling by the IL-12-Fc fusions via IL-12 receptors, are depicted in FIGS. 17A-17D.

The data show that both XENP27201 and XENP27203 were active in inducing STAT4 phosphorylation in various lymphocyte populations to a similar level as that induced by recombinant IL-12, while the bivalent IL-12p40-Fc (XENP27560) and bivalent IL-12p35-Fc (XENP27561) fusions were inactive. Notably, the two IL-12-Fc fusion formats demonstrated similar potency. Additionally, the ability of the purified IL-12-Fc fusion proteins to induce STAT4 phosphorylation in comparison to XENP27560 and XENP27561 confirms that that peak B isolated from purification part 2 for both XENP27201 and XENP27203 (as described in Example 1B) consisted of the active species comprising the complete IL-12 heterodimer.

Example 2: IL-12 Variants Engineered for Reduced Potency

In order to further prolong half-life as well as reduce potential for toxicity, we engineered IL-12 variants with decreased binding affinity for IL-12 receptors as we reasoned that this would decrease the antigen sink as well as reduce potency.

XIV. 2A: Engineering IL-12p40 and IL-12p35 Variants (Round 1)

2A(a): Engineering IL-12p40 Variants

We first identified W15, P17, D18, A19, P20, G21, M23, L40, D41, Q42, S43, E45, L47, T54, 155, Q56, K58, E59, F60, G61, D62, Y66, and K84 as potential sites on IL-12p40 for introducing affinity-modulating substitutions (residues depicted in FIG. 18).

As a second strategy, by using the QuaSAR package in MOE software, we identified highly exposed aspartic acid, glutamic acid, asparagine, and glutamine residues (according to the water accessible surface area calculated using a radius of 1.4 Å for the water molecule and a polyhedral representation for each atom) in the IL-12p40 crystal structure (PDB code 3HMX) reasoning that these residues may contribute to binding between IL-12p40 and the IL-12 receptors. In particular, we focused our search on residues at which we could incorporate isosteric substitutions (i.e. Asn and Asp; and Gln and Glu), with the aim to minimize potential for immunogenicity, Accordingly, we identified E3, D7, E12, D14, D18, E22, D29, E32, E33, D41, Q42, E45, Q56, E59, D62, Q65, E73, E86, D93, D97, E100, N103, E110, D129, D142, Q144, E156, D161, N162, E166, E170, Q172, D174, E187, N200, D209, D214, N218, Q220, N226, Q229, E231, E235, Q256, E262, D265, D270, N281, Q289, and E299 which have an ASA score of at least 19 (residues and ASA scores depicted in FIG. 19).

As described above, the p40 subunit is shared by IL-12 and IL-23. Bloch et al. (2018) reported the crystal structure for IL-23 in complex with IL-23R and Nb22E11. As a third strategy, we reasoned that residues on the IL-12p40 subunit in contact with IL-23R may also be involved with binding the analogous receptor IL-12R132 in the IL-12 receptor complex. Accordingly, using the crystal structure reported by Bloch et al. (PDB code 5MZV) and modeling in MOE software, we identified D87, G88, 189, W90, K104, and F106 as residues on IL-12p40 potentially in contact with IL-12R132 (residues and predicted contact type depicted in FIG. 20).

Finally, to ensure that we do not disturb the natural interaction between the IL-12p40 and IL-12p35 subunits, we identified the following residues on IL-12p40 potentially in contact with IL-12p35 based on the crystal structure reported by Luo et al. (2010): K102, Y114, A176, C177, P178, A179, A180, E181, S183, P185, S204, F206, R208, T242, P243, S245, Y246, F247, S248, D290, R291, Y292, and Y293.

In view of the above we designed a number of IL-12p40 variants, in particular as described above, at residue at which isosteric substitutions could be introduced, with the aim to to reduce the affinity of the IL-12 heterodimer to IL-12 receptors. Substitutions to remove potential N-glycosylation sites in p40 were also designed to examine the impact of glycosylation on protein heterogeneity. Sequences for illustrative variants are depicted in FIGS. 21A-21F. Plasmids coding for the IL-12p40 variants were constructed by standard gene synthesis, followed by subcloning into a pTT5 expression vector containing Fc fusion partners (e.g., constant regions as depicted in FIGS. 8A-8D), corresponding amino acid sequences for which are depicted in FIGS. 22A-22G.

2A(b): Engineering IL-12p35 Variants

As with the second strategy described above, we used the QuaSAR package in MOE software to identify highly exposed aspartic acid, glutamic acid, asparagine, and glutamine residues in the IL-12p35 crystal structure (PDB code 3HMX) reasoning that these residues may contribute to binding between the IL-12 heterodimeric complex and the IL-12 receptors. Again, we focused here, in particular, on residues at which we could incorporate isosteric substitutions, to minimize the potential for immunogenicity. We identified Q35, E38, E46, D55, E67, N71, N76, N85, Q135, Q146, N151, E153, E162, and E163 which have an ASA score of at least 103 (residues and ASA scores depicted in FIG. 23).

As above, to ensure that we do not disturb the natural interaction between the IL-12p40 and IL-12p35 subunits, we identified the following residues on IL-12p35 potentially in contact with IL-12p40 based on the crystal structure reported by Luo et al. (2010): Q20, S44, E45, E46, H49, K54, T59, V60, E61, C63, L64, P65, E67, L68, S73, C74, R181, I182, R183, V185, T186, D188, R189, V190, S192, Y193, and A196.

In view of the above we designed a number of IL-12p35 variants with isosteric substitutions with the aim to reduce the affinity of the IL-12 heterodimer to IL-12 receptors. Substitutions to remove potential N-glycosylation sites in p35 were also designed to examine the impact of glycosylation on protein heterogeneity. Sequences for illustrative variants are depicted in FIGS. 24A-24B. Plasmids coding for the IL-12p35 variants were constructed by standard gene synthesis, followed by subcloning into a pTT5 expression vector containing Fc fusion partners (e.g., constant regions as depicted in FIGS. 8A-8D), corresponding amino acid sequences for which are depicted in FIGS. 25A-25C.

2A(c): Engineering IL-12p35 Variants

Illustrative variant IL-12-Fc fusion proteins having the above described variant IL-12 subunits were designed with the view to generate IL-12-Fc fusions having reduced affinity for the IL-12 receptors in order to reduce potency, sequences for which are depicted in FIG. 26A-FIG. 26Q. We produced and purified the IL-12-Fc fusions as generally described in Example 1B, and investigated their activity in a pSTAT4 assay.

Human PBMCs were activated with 100 ng/ml anti-CD3 (OKT3) for 2 days. Activated PBMCs were then incubated with the indicated test articles at 37° C. for 15 minutes. Cells were then stained with anti-CD3-BUV395 (UCHT1), anti-CD4-BV605 (RPAT4), anti-CD8-AF700 (SK1), anti-CD25-BV510 (M-A251), anti-CD45RA-BV421 (HI100), anti-CD56-PE (N901), anti-FoxP3-AF488 (259D), and anti-pSTAT4-AF647 (38/p-Stat4) using PerFix EXPOSE kit (Beckman Coulter, Indianapolis, Ind.) and analyzed by flow cytometry.

Data showing induction of STAT4 phosphorylation on CD4+CD45RA+CD25+ and CD8+CD45RA+CD25+ T cells by IL-12-Fc fusion having IL-12p35 or IL-12p40 variants are depicted respectively in FIGS. 27A-27B and FIGS. 28A-28B. FIG. 29 depicts the EC50 of the various variant IL-12-Fc fusions and the fold decrease in EC50 relative to WT IL-12-Fc XENP27201. The data show that most of the IL-12-Fc fusions comprising variant IL-12p40 subunits or IL-12p30 subunits exhibit decreased potency in inducing STAT4 phosphorylation. Notably, E59Q and E235Q substitutions in the IL-12p40 subunit, and E153Q and N151D substitutions in the IL-12p35 substitutions were able to individually provide over 2-fold reduction in potency for the variant IL-12-Fc fusions. Additionally, IL-12p40 double- and triple-mutants comprising E59Q provided up to 6.5-fold reduction in potency.

Surprisingly, two variant IL-12-Fc fusions comprising IL-12p40(D87N) or IL-12p40(E262Q) exhibited an increase in potency. While we are interested in decreasing potency with the aim to decrease antigen sink and thereby increase the half-life of IL-12-Fc fusions, IL-12-Fc fusions having increased potency may find use in other contexts.

2B: Engineering IL-12p40 and IL-12p35 Variants (Round 2)

In order to engineer further IL-12p40 and IL-12p35 variants with the aim to reduce their affinity for the IL-12 receptors and reduce the potency of the biologically active IL-12 complex, we re-applied the strategies described in Example 2A with expanded criteria. For example, we used a lower ASA score threshold than that defined in Example 2A for identifying IL-12p40 and IL-12p35 residues at which to introduce substitutions. We also expanded our criteria to include additional amino acid residues, with a particular focus on larger residues such as lysine, at which introduction of substitutions was more likely to disrupt the interaction of IL-12p35, IL-12p40, and/or the IL-12 complex with the IL-12 receptors. Similarly, we introduced non-isosteric substitutions, with a particular focus on larger residues such as lysine, to disrupt the interaction of IL-12p35, IL-12p40, and/or the IL-12 complex with the IL-12 receptors. Using these approaches, we further identified D34, K99, K163, K258, and K260 in the IL-12p40 subunit; and N21, E79, Q130, N136, E143, K158, and D165 in the IL-12p35 subunit as residues suitable for engineering substitutions. In additional, we generated additional combination variants incorporating substitutions identified in Example 2 which contributed the greatest reduction in potency.

In view of the above, we designed further IL-12p40 and IL-12p35 variants, illustrative sequences for which are depicted respectively in FIGS. 30A-30B and FIG. 32. As above, plasmids coding for the IL-12p40 and IL-12p35 variants were constructed by standard gene synthesis, followed by subcloning into a pTT5 expression vector containing Fc fusion partners, corresponding amino acid sequences for which are depicted respectively in FIGS. 31A-31C and FIGS. 33A and 33B. IL-12-Fc fusion proteins were generated with the additional variant IL-12 subunits, sequences for which are depicted in FIG. 34A-FIG. 34L, and produced as generally described in Example 1B.

The activity of the additional variant IL-12-Fc fusions were investigated in a pSTAT4 assay as generally described above. In particular, human PBMCs were activated with 100 ng/ml anti-CD3 (OKT3) for 2 days. Activated PBMCs were then incubated with the indicated test articles at 37° C. for 15 minutes. Cells were then stained with anti-CD3-BUV395 (UCHT1), anti-CD4-BV605 (RPAT4), anti-CD8-AF700 (SK1), anti-CD25-BV510 (M-A251), anti-CD45RA-BV421 (H1100), and anti-CD56-PE (N901). Next, cells were permeabilized using PerFix EXPOSE (Beckman Coulter, Indianapolis, Ind.). Following permeabilization, cells were stained with anti-FoxP3-AF488 (259D) and anti-pSTAT4-AF647 (38/p-Stat4) and analyzed by flow cytometry. Data depicting pSTAT4 MFI on CD4+CD45RA+CD25+ and CD8+CD45RA+CD25+ T cells are depicted in FIGS. 35A-35B and FIGS. 36A-35B, and data depicting the EC50 (and fold decrease relative to WT IL-12-Fc XENP27201) are shown in FIG. 37. The data show that most of the IL-12-Fc fusions comprising variant IL-12p40 and/or IL-12p30 subunits exhibit decreased potency in inducing STAT4 phosphorylation.

2C: Engineering IL-12p40 and IL-12p35 Variants (Round 3)

In Example 2B, we found that IL-12-Fc fusion XENP29952 comprising IL-12p40(E59K) enabled a ~12 fold reduction, in contrast to IL-12-Fc fusion XENP28825 comprising IL-12p40(E59Q) which had only about 2-fold reduction in potency. Additionally, we noted that several double mutants comprising E59Q in the IL-12p40 subunit demonstrated >3.5 fold reduction in potency (e.g. XENP29953, XENP29954, and XENP29959). Further, we noted that while XENP28846 comprising IL-12p35(N151D) enabled increased potency, IL-12p35(D55Q/N151D) actually enabled ~2-fold reduction in potency, which indicated to us that modification of D55 in the IL-12p35 subunit contributes greatly to a reduction in potency. Accordingly, to further reduce the potency of IL-12-Fc fusions, we generated additional combination variants incorporating substitutions in Example 2B which contributed the greatest reduction in potency. In addition as in Example 2B, we further included non-isosteric substitutions, with a particular focus on larger residues such as lysine.

In view of the above, we designed further IL-12p40 and IL-12p35 variants, illustrative sequences for which are depicted respectively in FIG. 38 and FIG. 39. IL-12-Fc fusion proteins were generated with the additional variant IL-12 subunits, sequences for which are depicted in FIG. 40A-FIG. 40G, and produced as generally described in Example 1B. The activity of the additional variant IL-12-Fc fusions were investigated in a pSTAT4 assay as generally described above. Data depicting pSTAT4 MFI on CD4+CD45RA+CD25+ and CD8+CD45RA+CD25+ T cells are depicted in FIGS. 41A and 41B, and data depicting the EC50 (and fold decrease relative to WT IL-12-Fc XENP27201) are shown in FIG. 42. The data show that all of the new IL-12-Fc fusions comprising variant IL-12p40 and/or IL-12p30 subunits exhibited substantially decreased potency in inducing STAT4 phosphorylation. Notably, XENP30607 and XENP30608 exhibited ~100-fold decrease in potency in comparison to XENP27201.

2D: Engineering IL-12p40 and IL-12p35 Variants (Round 4)

We further engineered the IL-12p40 and IL-12p35 subunits both by incorporating additional variants found in Example 2 contribute to a shift in potency, and by further using non-isosteric substitutions, with a particular focus on larger residues such as lysine and tyrosine, to disrupt the interaction of IL-12p35, IL-12p40, and/or the IL-12 complex with the IL-12 receptors.

In addition, we performed further structural analysis in the MOE software based on surface exposure to identify additional residues in the IL-12p40 and IL-12p35 subunits at which to introduce modifications. We further identified residues R159 and K264 in the IL-12p40 subunit; and residues L75, L89, F96, M97, L124, M125, and I171 in the IL-12p35 subunit. We used the earlier described approaches, as well as alanine substitutions (in line with the alanine scanning mutagenesis technique), to preliminarily investigate the effect of modifications at these additionally identified residues.

In view of the above, we designed further IL-12p40 and IL-12p35 variants, illustrative sequences for which are depicted respectively in FIG. 43A, FIG. 43B, and FIG. 44. IL-12-Fc fusion proteins were generated with the additional variant IL-12 subunits, sequences for which are depicted in FIG. 45A-FIG. 451 and FIG. 46A-FIG. 46C, and produced as generally described in Example 1B.

The activity of the additional variant IL-12-Fc fusions were investigated in a pSTAT4 assay as generally described above. Data depicting pSTAT4 MFI on CD4+CD45RA+CD25+, CD4+CD45RA-CD25+, CD8+CD45RA+CD25+, and CD8+CD45RA-CD25+ T cells are depicted in FIG. 47A-FIG. 47D, and data depicting the EC50 (and fold decrease relative to WT IL-12-Fc XENP27201) are shown in FIG. 48. The data show that all of the new IL-12-Fc fusions comprising variant IL-12p40 and/or IL-12p30 subunits exhibited substantially decreased potency in inducing STAT4 phosphorylation.

Example 3: Bivalent IL-12-Fc Fusions

We also conceived bivalent IL-12-Fc fusions. One such format is the bivalent N-terminal IL-12-Fc fusion format (FIG. 49A-FIG. 49B) which comprises two identical monomers each comprising a scIL-12 complex recombinant fused to the N-terminus of a homodimeric Fc chain (optionally via a domain linker). Another such format is the bivalent C-terminal IL-12-Fc fusion format (FIG. 49C-FIG. 49D) which comprises two identical monomers each comprising a scIL-12 complex recombinant fused to the C-terminus of a homodimeric Fc chain (optionally via a domain linker).

Example 4: Reduced Potency IL-12 Variants in Alternative IL-12-Fc Fusion Formats We also investigated the IL-12 variants in the context of additional IL-12-Fc fusion formats. Fusions in the scIL-12 (p40/p35)-Fc and (scIL-12(p40/p35))$_2$-Fc formats were generated with either WT IL-12p40 subunits or variant IL-12p40(E59K/K99E) subunits and produced as generally described in Example 1B (and sequences for which are depicted in FIG. 50-FIG. 51).

The activity of the IL-12-Fc fusions were investigated in a pSTAT4 assay as generally described above. In particular, human PBMCs were activated with 100 ng/ml anti-CD3 (OKT3) for 2 days at 37° C. Activated PBMCs were then incubated with the indicated test articles for 15 minutes at 37° C. Cells were then stained with anti-CD3-BUV395 (UCHT1), anti-CD4-BV605 (RPAT4), anti-CD8-AF700 (SK1), anti-CD25-BV711 (M-A251), anti-CD45RA-BV421 (HI100), and anti-CD56-PE (N901). Next, cells were permeabilized using PerFix EXPOSE (Beckman Coulter, Indianapolis, Ind.). Following permeabilization, cells were stained with anti-FoxP3-V450 (259D) and anti-pSTAT4-AF647 (38/p-Stat4) and analyzed by flow cytometry. Data depicting pSTAT4 MFI on CD4+CD45RA+CD25+, CD4+CD45RA-CD25+, CD8+CD45RA+CD25+, and CD8+CD45RA-CD25+ T cells are depicted in FIG. 52A-FIG. 52D, and data depicting the EC50 (and fold decrease relative to WT IL-12-Fc XENP27201) are shown in FIG. 53. The data show that IL-12-Fc fusions in the various format demonstrated very similar potency, and the IL-12-Fc fusions in scIL-12(p40/p35)-Fc and (scIL-12(p40/p35))$_2$-Fc fusions comprising variant IL-12p40(E59K/K99E) subunits demonstrated very similar potency to IL-12-Fc fusions in the IL-12-heteroFc format comprising variant IL-12p40(E59K/K99E) subunit.

Example 5: IL-12-Fc Fusions Enhance Allogeneic Anti-Tumor Effect of T Cells In Vivo Next, we investigated in vivo anti-tumor effect of the IL-12-Fc fusions of the invention. NOD SCID gamma (NSG) mice were engrafted intradermally with 3×10$^6$ pp-65 expressing MCF-7 cells in the right flank on Day −15. On Day 0, mice were engrafted intraperitoneally with 1.5×10$^6$ human PBMCs. Mice (n=15) were then treated on Days 0, 7, 14, and 21 with 0.03 mg/kg XENP29952, a reduced potency IL-12-Fc fusion in the IL-12-heteroFc format comprising variant IL-12p40(E59K). Controls (n=10) used were PBS and XENP16432 (a bivalent anti-PD-1 mAb, a checkpoint inhibitor which enhances anti-tumor activity by de-repressing the engrafted human T cells; sequences depicted in FIG. 53). Tumor volumes were monitored by caliper measurements, data for which are shown (days post 1$^{st}$ dose) in FIG. 54. Blood and serum were drawn on Days 7, 14, and 21 and analyzed by flow cytometry to investigate expansion of human lymphocytes, data for which are depicted in FIG. 55A-FIG. 55D, as well as by U-PLEX Biomarker Group 1 Human Assays (Meso Scale, Rockville, Md.) for serum cytokine concentrations, data for which are depicted in FIG. 56A-FIG. 56F.

The data show that the IL-12-heteroFc fusion XENP29952 had significantly enhanced expansion of CD45$^+$, CD3$^+$ T cells, CD4$^+$ T cells, CD8$^+$ T cells, and NK cells by Day 14 in comparison to both PBS control and checkpoint blockade by XENP16432 (statistics performed on log-transformed data using unpaired t-test). Notably, XENP29952 significantly enhanced anti-tumor activity by Day 11 as indicated by change in tumor volume (statistics performed on baseline corrected data using unpaired t-test). Furthermore, XENP29952 significantly enhanced secretion of IFNγ and CD25 by Day 7 in comparison to checkpoint blockade by XENP16432 (statistics performed on log-transformed date using unpaired t-test).

In addition to anti-tumor activity, the engrafted human PBMCs develop an autoimmune response against mouse cells and subsequently graft-versus-host disease (GVHD). Accordingly, it should be noted that while all the animals treated with XENP29952 were dead by Day 19, this was likely due to their succumbing to GVHD exacerbated by significantly enhanced expansion of human lymphocytes. This highlights the importance of reduced potency IL-12 variants not just for improving pharmacokinetics but also for improving therapeutic index.

Example 6: IL-12-Fc Fusions Demonstrate Modulated Activity In Vivo Correlating to In Vitro Potency As all the animals treated with XENP29952 in Example 5 were dead as a result of GVHD, we investigated the in vivo activity of IL-12-Fc fusions engineered with reduced potency IL-12 variants in a GVHD study.

NSG mice were engrafted with 10×10$^6$ human PBMCs via IV-OSP on Day −1 and dosed intraperitoneally on Days 0, 7, 14, and 21 with the following test articles: XENP29952 (a reduced potency IL-12-Fc fusion in the IL-12-heteroFc format comprising variant IL-12p40(E59K)), XENP30597 (a reduced potency IL-12-Fc fusion in the IL-12-heteroFc format comprising variant IL-12p40(E59K/K99E)), XENP31254 (a reduced potency IL-12-Fc fusion in the IL-12-heteroFc format comprising variant IL-12p40(D18K/E59K/K99E)), XENP31251 (a reduced potency IL-12-Fc fusion in the IL-12-heteroFc format comprising variant IL-12p40(E59K/K99Y)), or XENP31258 (a reduced potency IL-12-Fc fusion in the IL-12-heteroFc format comprising variant IL-12p40(E59K/K99E/K264E)) at 0.3 or 0.03 mg/kg. Body weights were assessed twice per week as an indicator of GVHD, data for which are depicted in FIG. 58A-FIG. 58I as a change in body weight (relative to initial body weight). Additionally, blood was drawn on Day 7, 10, 14, and 31 to investigate the activation of various T cell populations as indicated by PD-1 expression levels (data for which are depicted in FIG. 59A-FIG. 69C and FIG. 60A-FIG. 60C), and serum was drawn to investigate cytokine secretion (data for which are depicted in FIG. 61A-FIG. 61D). Notably, the data show a dose response for the test articles (i.e. enhanced GVHD, T cell activation, and IFNγ secretion by 0.3 mg/kg dose in comparison to 0.03 mg/kg dose).

It was surprising that XENP31251, which appeared to be one of the weakest variants in inducing STAT4 phosphorylation on CD4$^+$ T cells in vitro (see FIG. 47A-FIG. 47B), was one of the stronger inducers of GVHD. Accordingly, we re-investigated the in vitro activity of the same illustrative reduced potency IL-12-Fc in a STAT4 phosphorylation assay as generally described above using two separate PBMC donors. Human PBMCs were activated with 1 µg/ml anti-CD3 (OKT3) for 2 days at 37° C. Activated PBMCs were then incubated with the indicated test articles at 37° C. for 15 minutes.

Cells were then stained with anti-CD3-BUV395 (UCHT1), anti-CD4-BV605 (RPAT4), anti-CD8-AF700 (SK1), anti-CD25-BV510 (M-A251), anti-CD45-BV785, anti-CD45RA-BV421 (HI100), anti-CD16-PE (B73), and anti-CD56-PE (N901). Next, cells were permeabilized using PerFix EXPOSE (Beckman Coulter, Indianapolis, Ind.). Following permeabilization, cells were stained with anti-FoxP3-AF488 (259D) and anti-pSTAT4-AF647 (38/p-Stat4) and analyzed by flow cytometry. Induction of STAT4 phosphorylation on various lymphocyte populations in PBMCs from the first donor are depicted in FIGS. 62A-62K (data not shown for the second donor). The data from both donors and across the various lymphocyte populations show a potency ladder with XENP29952 as the most potent variant, XENP31254 and XENP31258 as the least potent variants, and XENP30597 and XENP31251 falling in between. Notably, the degree of GVHD, T cell activation, and IFNγ secretion as induced by the reduced potency IL-12-Fc fusion variants in vivo correlated with the in vitro potency. For example, at 0.03 mg/kg dose, XENP29952 induced greater GVHD, T cell activation, and IFNγ secretion than all the reduced potency IL-12-Fc fusions, while XENP31254 and XENP31258 induced the least GVHD, T cell activation, and IFNγ secretion.

Example 7: IL-12-Fc Fusions Have Anti-Tumor Activity and Combine Productively with Checkpoint Blockade Next, we investigated the in vivo anti-tumor effect of combining the additional IL-12-Fc fusions as well as the effect of combining the IL-12-Fc fusions with checkpoint blockade. NSG mice were engrafted intradermally with $3\times10^6$ pp-65 expressing MCF-7 cells in the right flank on Day −15. On Day 0, mice were engrafted intraperitoneally with $5\times10^6$ human PBMCs. Mice were then treated on Days 0, 7, 14, and 21 with 0.1 mg/kg XENP31251 alone or in combination with 3.0 mg/kg anti-PD-1 mAb XENP16432. Controls used were PBS, 3.0 mg/kg XENP16432 alone, and XENP31258. Tumor volumes were monitored by caliper measurements, data for which are shown (days post $1^{st}$ dose) in FIG. 63A-FIG. 63D. Blood was drawn on Days 7, 14, and 21 and analyzed by flow cytometry to investigate expansion of human lymphocytes, data for which are depicted in FIG. 64A-FIG. 64F for Day 14.

The data show that XENP31258 significantly enhanced anti-tumor activity by Day 14, and XENP31251 (alone or in combination with XENP16432) significantly enhanced anti-tumor activity (as indicated by change in tumor volume) by Day 16 in comparison to treatment with PBS (statistics performed on baseline corrected data using Mann-Whitney test). Notably, the data show that XENP31251 in combination with XENP16432 significantly enhanced anti-tumor activity by Day 21 in comparison to treatment with XENP16432 alone; and that treatment with XENP31251 in combination with XENP16432 significantly enhanced lymphocyte expansion in comparison to either XENP31251 or XENP16432 alone, indicating that IL-12-Fc fusions combine productively with checkpoint blockade.

Example 8: Removing Free Cysteine in IL-12p40 Subunit

The IL-12p40 subunit has a free cysteine at position 252 (numbered according to the human IL-12 subunit beta (IL-12p40) mature form sequence as depicted in FIG. 1) which may bond with other free cysteines leading at least to heterogeneity and at worse to immunogenicity. Accordingly, IL-12p40 variants were engineered to remove the free cysteine, for example, by introducing C252S modification (although other substitutions may also be used). Modification of C252 (e.g., C252S) can be used alone or in combination with any other IL-12p40 variants, such as affinity or expression variants. Illustrative IL-12p40 variants comprising a modification at C252 to remove the free cysteine are depicted in FIG. 66A-FIG. 66C. Illustrative IL-12-Fc fusions proteins were generated with the additional variant IL-12p40 subunits, sequences for which are depicted in FIG. 67A-FIG. 67N, and produced as generally described in Example 1B.

The activity of the IL-12p40 variants engineered to remove the free cysteine were investigated in a pSTAT4 assay as generally described above in order to ascertain that removal of the free cysteine did not engender any change in activity. Activated PBMCs were incubated with the indicated test articles and pSTAT4 MFI on various populations were assessed, data for which are depicted in FIGS. 68A-68E. The data show that the variants comprising the C252S modification demonstrated similar activity to the counterpart variant which did not comprise the C252S modification. Notably, for 3 of the 4 variants tested for which we engineered versions with and without the C252S mutation (e.g., D18K/E59K/K99E; D18K/E59K/K99E/K264E; and E59K/K99E), the C252S mutation appeared to slightly increase the potency of the IL-12-Fc fusions.

Example 9: PD-1 Targeting Arm

As described above, PD-1 expression is upregulated on activated tumor infiltrating lymphocytes. Accordingly, targeting IL-12-Fc fusions proteins of the invention to PD-1 expressing lymphocytes could be a useful approach for directing IL-12-Fc fusions to the tumor environment and avoiding systemic toxicity. Sequences for anti-PD-1 mAbs whose variable regions are contemplated for use herein are depicted in FIG. 70A-FIG. 70I, FIG. 71, and FIG. 72.

9A: mAb a, mAb B, and mAb C do not Cross-Compete for Binding with Nivolumab

Additionally, as it would be useful to combine the targeted IL-12-Fc fusion proteins of the invention with PD-1 blockade antibodies, or administer targeted IL-12-Fc fusion proteins of the invention subsequent to treatment with PD-1 blockade antibodies, it is important that the PD-1 targeting arm of the targeted IL-12-Fc fusion protein does not bind the same or similar epitope as the PD-1 blockade antibody. PD-1 blockade antibodies contemplated herein include, but are not limited to, nivolumab and pembrolizumab. To investigate if the anti-PD-1 binding domains described above competed with nivolumab and pembrolizumab, we performed tandem epitope binning on the chimeric mAbs. Tandem epitope binning was performed using the Octet HTX instrument. HIS1K biosensors were first used to capture PD-1-His followed by dipping into 100 nM of a first antibody and then dipping into 100 nM of a second antibody. Antibodies tested were XENP16432 (a bivalent anti-PD-1 mAb based on nivolumab; sequence depicted in FIG. 54), XENP21461 (pembrolizumab; sequence depicted in FIG. 54, chimeric mAb A, chimeric mAb B, chimeric mAb C, and a 1C11-based mAb. PD-L1-Fc was also included to investigate the blocking of PD-1:PD-L1 interaction by the antibodies. BLI-responses were normalized against the BLI-response of dipping the biosensor into HBS-EP buffer followed by dipping into the anti-PD-1 antibodies. If the antibody pair provided a normalized BLI-response less than 0.5, the pair was considered competing or partially competing and to be in the same epitope bin, i.e., recognizing very similar, or largely overlapping, epitopes. If the antibody pair provided a normalized BLI-response greater than 0.5, the pair was considered non-competing and to bin to different epitopes. The normalized BLI-response for each of the antibody pairs are summarized in FIG. 73.

The binning shows that anti-PD-1 mAb A, mAb B, and mAb C do not compete with nivolumab or pembrolizumab, while the 1C11-based mAb competed with both nivolumab and pembrolizumab. Additionally, mAb A does not appear to block the PD-1:PD-L1 interaction, while mAb B and mAb C block the PD-1:PD-L1 interaction.

For ease, PD-1 binding domains which compete with nivolumab and/or pembrolizumab are hereon referred to as anti-PD-1[C], and PD-1 binding domains which do not compete with nivolumab and/or pembrolizumab are referred to as anti-PD-1[NC].

9B: mAb C is Cross-Reactive for Human and Cynomolgus PD-1

Further, for ease of clinical development, it is useful to investigate various parameters of the PD-1-targeted IL-12-Fc fusions such as pharmacokinetics, pharmacodynamics, and toxicity in cynomolgus monkeys. We investigated the binding of XENP28536 to human and cynomolgus PD-1 using Octet, as generally described above. In particular, anti-human Fc (AHC) biosensors were used to capture the antibodies and dipped into multiple concentrations of human and cynomolgus PD-1-His to determine KD, data for which are depicted in FIG. 74A-FIG. 74B.

9C: Affinity Optimization of mAb C-Based ABD

We engineered affinity optimized variants of mAb C. A library of variants was constructed by standard mutagenesis to introduce point mutations into the variable heavy or variable light regions of XENP28536. Illustrative sequences are depicted in FIG. 70A-FIG. 70I (variable domain sequences). Affinity screens of the affinity-engineered mAb C[PD-1]_H1L1 variants (in bivalent IgG1 format with E233P/L234V/L235A/G236_/S267K ablation variants) were performed on Octet as generally described above, data for which are depicted in FIG. 75A-FIG. 75I. Out of 304 variants having single point mutation in either the variable heavy or variable light region, we only identified 11 variants (including mAb C[PD-1]_H1_L1.1 and mab_C[PD-1]_H1_L1.3) having greater than 2-fold improved affinity over WT. Favorable VH substitutions were at positions 32, 52A, and 97 (numbering according to Kabat); and favorable VL substitutions were at positions 27D, 30, 93, and 94 (numbering according to Kabat).

Favorable single substitution VH variants and/or single substitution VL variants were combined to generate additional variants, sequences for which are depicted in FIG. 70A-FIG. 70I.

Example 10: PD-L1 Targeting Arm

As described above, PD-L1 are overexpressed by tumor cells. Accordingly, targeting IL-12-Fc fusions proteins of the invention to PD-L1 expressing tumor cells could be a useful approach for directing IL-12 fusions to the tumor environment and avoiding systemic toxicity. Sequences for several anti-PD-L1 mAbs whose variable regions are contemplated for use herein are depicted in FIG. 76A-FIG. 76J.

Example 11: Targeted IL-12-Fc Fusions

11A: Engineering and Producing Targeted IL-12-Fc Fusions

Plasmids coding for IL-12p40 subunit, IL-12p35 subunit, or the variable regions of the antigen binding domain were constructed by standard gene synthesis, followed by subcloning into a pTT5 expression vector containing Fc fusion partners (e.g., constant regions as depicted in FIG. 77-FIG. 78). Cartoon schematics of illustrative targeted IL-12-Fc fusions are depicted in FIG. 79A-FIG. 79E.

A particular illustrative format, the "scIL-12×Fab" format (FIG. 79B), comprises a single-chain IL-12 complex (or "scIL-12 complex") recombinantly fused to the N-terminus of a heterodimeric Fc-region, with a variable heavy chain (VH) fused to the other side of the heterodimeric Fc, while a corresponding light chain is transfected separately so as to form a Fab with the VH.

We generated targeted IL-12-Fc fusions in this format with anti-PD-1 targeting arms, anti-PD-L1 targeting arms, and control anti-RSV targeting arms, respectively referred to hereon as PD-1-targeted IL-12-Fc fusions, PD-L1-targeted IL-12-Fc fusions, and RSV-targeted IL-12-Fc fusions, illustrative sequences for which are depicted in FIG. 80A-FIG. 80J, FIG. 81A, FIG. 81B, and FIG. 82A-FIG. 82H. IL-12-Fc fusions without a targeting arm are hereon referred to interchangeably with untargeted IL-12-Fc fusions.

Proteins were produced by transient transfection in HEK293E cells and were purified by a two-step purification process comprising protein A chromatography and ion exchange chromatography.

11B: Targeted IL-12-Fc Fusions Demonstrate Enhanced Activity In Vitro

In a first experiment, the activity of targeted IL-12-Fc fusions comprising WT and reduced potency IL-12[p40 (E59K/K99E)] variant were investigated in a pSTAT4 (as generally described above; data depicted in FIG. 83A and FIG. 83B). In a second experiment, the activity of targeted IL-12-Fc fusions comprising additional reduced potency IL-12 variants were investigated in a pSTAT4 assay (data depicted in FIG. 84).

Collectively, the data show that RSV-targeted IL-12-Fc fusions demonstrate comparable activity to untargeted IL-12-Fc fusions; that PD-1-targeted IL-12-Fc fusions were more potent than untargeted (or RSV-targeted) IL-12-Fc fusions; and that PD-L1-targeted IL-12-Fc fusions were more potent than both untargeted (or RSV-targeted) IL-12-Fc fusions and PD-1-targeted IL-12-Fc fusions. Notably, the first experiment show that PD-1-targeting does not enhance potency of WT IL-12, suggesting that targeting may only be necessary in the context of reduced potency IL-12. Accordingly, it is expected that outside of the tumor environment, the PD-1-targeted and PD-L1 targeted reduced potency IL-12-Fc fusions will demonstrate very weak activity commensurate with that of untargeted (or RSV-targeted) reduced potency IL-12-Fc fusions, while in the tumor environment, the PD-1-targeted and PD-L1 targeted IL-12-Fc fusions will demonstrate restored potent activity.

11C: Targeted IL-12-Fc Fusions Demonstrate Enhanced Activity In Vivo

PD-1-targeted IL-12-Fc fusions were investigated in a GVHD study. NSG mice (10 per group) were engrafted with $10 \times 10^6$ human PBMCs via IV-OSP on Day −1 and dosed intraperitoneally with the indicated test articles at the indicated concentrations on Days 0, 7, 14, and 21. Body weights were assessed twice per week as an indicator of GVHD (change in body weight as a percentage of initial body weight depicted in FIG. 85); blood was drawn on periodically over the course of the study (e.g., Day 0, Day 5, Day 7, Day 9, Day 11, Day 13, Day 14, Day 15, Day 17, Day 19, Day 21, and the like) to assess expansion of various lymphocytes (Day 14 data depicted in FIG. 86A-FIG. 86E); and the expression of PD-1 on $CD4^+$ and $CD8^+$ T cells were assessed (Day 14 data depicted in FIG. 87A-FIG. 87B). Notably, the data show that XENP31462 significantly enhanced GVHD in comparison to XENP31258 by Day 17, despite XENP31462 having been administered at a lower dose than XENP31258. Likewise, XENP31462 significantly enhanced lymphocyte expansion and activation in comparison to XENP31258 by Day 14.

The PD-1-targeted IL-12-Fc fusion was also investigated in a mouse anti-tumor model. For this study, NSG mice that were MHC I/II-DKO (NSG-DKO) and thus resistant to GVHD were used. NSG-DKO mice (10 per group) were intradermally inoculated with $3 \times 10^6$ pp65-transduced MCF-7 cells on Day −15. Mice were then intraperitoneally injected with $5 \times 10^6$ human PBMCs and treated with the indicated test articles on Day 0, and further treated with the indicated test articles on Days 7, 14, and 21. Tumor volume was measured by caliper three times per week, data for which are shown in FIG. 88. PD-1-targeted reduced potency I1-12-Fc fusion XENP31462 demonstrated equivalent anti-tumor activity to untargeted reduced potency IL-12-Fc despite having been administered at a 10-fold lower dose.

Example 12: Select Variants to Remove Potential N-Glycosylation Sites on IL12 Subunits Modulate Activity of IL-12-Fc Fusions The biological activity of IL-12-Fc fusions engineered with variants in the p40 and p35 subunits to remove glycosylation at putative N-glycosylation sites (as generally described in Example 2A) were investigated in a pSTAT4 assay as generally described above. Data comparing XENP32190 (IL-12-Fc fusions comprising IL-12p40 variant E59K/K99E/C252S/K264E) to corresponding molecules further comprising at least a p40[N103Q] deglycosylation variant are depicted in FIG. 122A; data comparing XENP32190 to corresponding molecules further comprising at least a p40[N113Q] deglycosylation variant are depicted in FIG. 122B; data comparing XENP32190 to corresponding molecules further comprising at least a p40[N200Q] deglycosylation variant are depicted in FIG. 122C; data comparing XENP32190 to corresponding molecules further comprising at least a p40[N281Q] deglycosylation variant are depicted in FIG. 122D; and data comparing XENP32190 to corresponding molecules further comprising at deglycosylation variants in the IL12p35 subunit are depicted in FIG. 123.

It was observed in FIG. 122A that the N103Q deglycosylation variant enhances potency of the IL-12-Fc fusions. Each of the IL-12-Fc fusions having the N103Q variant (with the exception of XENP32996 and XENP33002) demonstrated enhanced potency in comparison to XENP32190. Notably, XENP32996 and XENP33002 further include the N200Q deglycosylation variant. It was observed in FIG. 122 that the N200Q variant reduces potency of the IL-12-Fc fusions. Each of the IL-12-Fc fusions having the N200Q variant (with the exception of XENP32996 and XENP33002) demonstrated substantially reduced potency in comparison to XENP32190. Notably, XENP32996 and XENP33002 further include the N103Q variant. Collectively, the data suggests that an additive effect conveyed by the N103Q and N200Q variant. For example in XENP32996 and XENP33002, the N200Q variant decreases potency, while the N103Q restores potency. Further, this suggests that the N200Q variant conveys substantially decreased potency rather than complete abrogation of IL-12 activity. Interestingly, the reduction in potency conveyed by the N200Q variant is consistent with early computation work (as described in Example 2A) using the QuaSAR package in MOE wherein N200 was identified as a highly exposed residue which may contribute to binding between the IL12p40 subunit and IL-12 receptors.

Figure 122B:
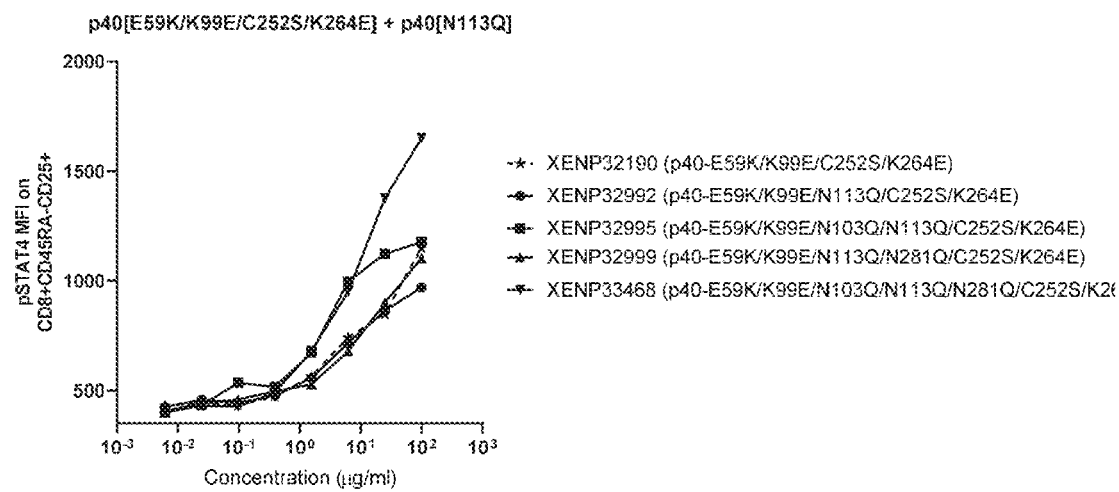
Figure 122C:
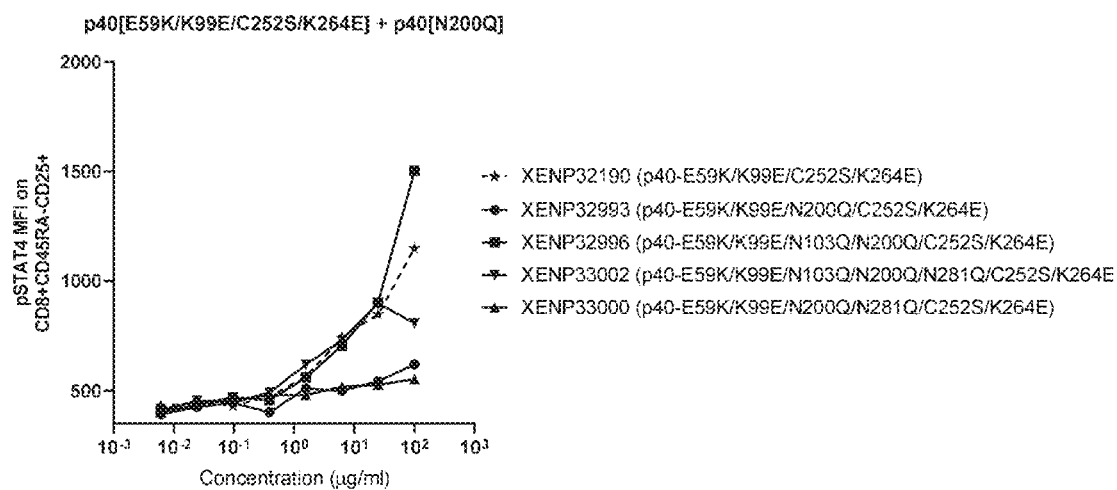
Figure 122D:
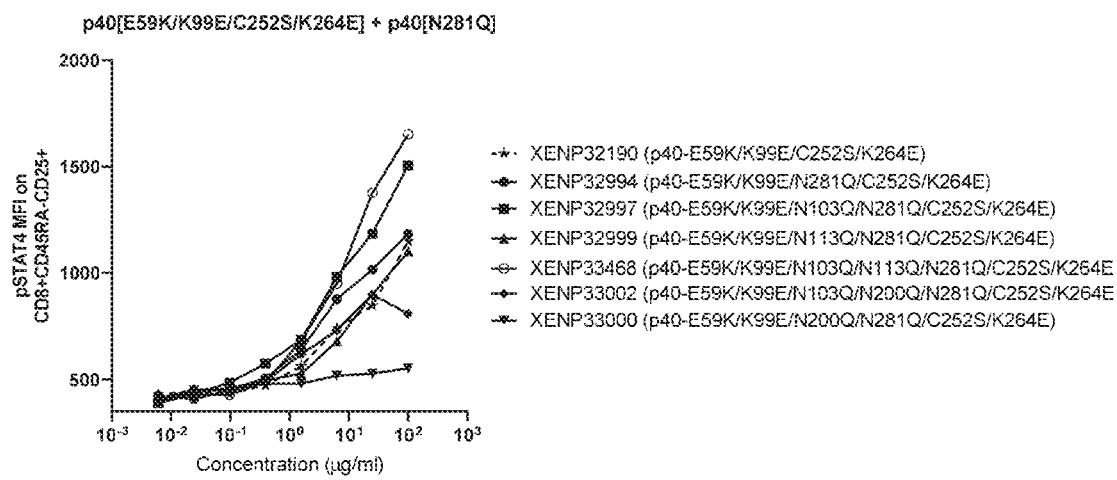

It was observed in FIGS. 122B and 122D that the N113Q and N281Q deglycosylation variants do not on their own impact IL12 activity (although the data for XENP32994 hints at a slight increase in potency). Consistent with the observation described above, further inclusion of the N200Q variant decreases potency and further inclusion of the N113Q variant increases potency of the IL-12-Fc fusions. Finally, it was observed in FIG. 123 that deglycosylation variants in the IL12p35 subunit do not modulate IL-12 activity.

The examples set forth above are provided to give those of ordinary skill in the art a complete disclosure and description of how to make and use the embodiments of the compositions, systems and methods of the invention, and are not intended to limit the scope of what the inventors regard as their invention. Modifications of the above-described modes for carrying out the invention that are obvious to persons of skill in the art are intended to be within the scope of the following claims. All patents and publications mentioned in the specification are indicative of the levels of skill of those skilled in the art to which the invention pertains. All references cited in this disclosure are incorporated by reference to the same extent as if each reference had been incorporated by reference in its entirety individually.

All headings and section designations are used for clarity and reference purposes only and are not to be considered limiting in any way. For example, those of skill in the art will appreciate the usefulness of combining various aspects from different headings and sections as appropriate according to the spirit and scope of the invention described herein.

All references cited herein are hereby incorporated by reference herein in their entireties and for all purposes to the same extent as if each individual publication or patent or patent application was specifically and individually indicated to be incorporated by reference in its entirety for all purposes.

Many modifications and variations of this application can be made without departing from its spirit and scope, as will be apparent to those skilled in the art. The specific embodiments and examples described herein are offered by way of example only, and the application is to be limited only by the terms of the appended claims, along with the full scope of equivalents to which the claims are entitled.

SEQUENCE LISTING (898 sequences)

SEQ ID NO: 1 - protein, 219 aa, Homo sapiens
MCPARSLLLVATLVLLDHLSLARNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 2 - protein, 197 aa, Homo sapiens
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 3 - protein, 328 aa, Homo sapiens
MCHQQLVISWFSLVFLASPLVAIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 4 - protein, 306 aa, Homo sapiens
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 5 - protein, 662 aa, Homo sapiens
MEPLVTWVVPLLFLFLLSRQGAACRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENPPQPQVRFSVEQLGQDGRRRLTLKEQPTQLELPEGCQGLAPGTEVTYRLQLHMLSCPCKAKATRTLHLGKMPYLSGAAYNVAVISSNQFGPGLNQTWHIPADTHTEPVALNISVGTNGTTMYWPARAQSMTYCIEWQPVGQDGGLATCSLTAPQDPDPAGMATYSWSRESGAMGQEKCYYITIFASAHPEKLTLWSTVLSTYHFGGNASAAGTPHHVSVKNHSLDSVSVDWAPSLLSTCPGVLKEYVVRCRDEDSKQVSEHPVQPTETQVTLSGLRAGVAYTVQVRADTAWLRGVWSQPQRFSIEVQVSDWLIFFASLGSFLSILLVGVLGYLGLNRAARHLCPPLPTPCASSAIEFPGGKETWQWINPVDFQEEASLQEALVVEMSWDKGERTEPLEKTELPEGAPELALDTELSLEDGDRCKAKM

SEQ ID NO: 6 - protein, 522 aa, Homo sapiens
CRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENPPQPQVRFSVEQLGQDGRRRLTLKEQPTQLELPEGCQGLAPGTEVTYRLQLHMLSCPCKAKATRTLHLGKMPYLSGAAYNVAVISSNQFGPGLNQTWHIPADTHTEPVALNISVGTNGTTMYWPARAQSMTYCIEWQPVGQDGGLATCSLTAPQDPDPAGMATYSWSRESGAMGQEKCYYITIFASAHPEKLTLWSTVLSTYHFGGNASAAGTPHHVSVKNHSLDSVSVDWAPSLLSTCPGVLKEYVVRCRDEDSKQVSEHPVQPTETQVTLSGLRAGVAYTVQVRADTAWLRGVWSQPQRFSIEVQVSD

SEQ ID NO: 7 - protein, 862 aa, Homo sapiens
MAHTFRGCSLAFMFIITWLLIKAKIDACKRGDVTVKPSHVILLGSTVNITCSLKPRQGCFHYSRRNKLILYKFDRRINFHHGHSLNSQVTGLPLGTTLFVCKLACINSDEIQICGAEIFVGVAPEQPQNLSCIQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDIRIKFQKASVSRCTLYWRDEGLVLLNRLRYRPSNSRLWNMVNVTKAKGRHDLLDLKPFTEYEFQISSKLHLYKGSWSDWSESLRAQTPEEEPTGMLDVWYMKRHIDYSRQQISLFWKNLSVSEARGKILHYQVTLQELTGGKAMTQNITGHTSWTTVIPRTGNWAVAVSAANSKGSSLPTRINIMNLCEAGLLAPRQVSANSEGMDNILVTWQPPRKDPSAVQEYVVEWRELHPGGDTQVPLNWLRSRPYNVSALISENIKSYICYEIRVYALSGDQGGCSSILGNSKHKAPLSGPHINAITEEKGSILISWNSIPVQEQMGCLLHYRIYWKERDSNSQPQLCEIPYRVSQNSHPINSLQPRVTYVLWMTALTAAGESSHGNEREFCLQGKANWMAFVAPSICIAIIMVGIFSTHYFQQKVFVLLAALRPQWCSREIPDPANSTCAKKYPIAEEKTQLPLDRLLIDWPTPEDPEPLVISEVLHQVTPVFRHPPCSNWPQREKGIQGHQASEKDMMHSASSPPPPRALQAESRQLVDLYKVLESRGSDPKPENPACPWTVLPAGDLPTHDGYLPSNIDDLPSHEAPLADSLEELEPQHISLSVFPSSSLHPLTFSCGDKLTLDQLKMRCDSLML

SEQ ID NO: 8 - protein, 599 aa, Homo sapiens
KIDACKRGDVTVKPSHVILLGSTVNITCSLKPRQGCFHYSRRNKLILYKFDRRINFHHGHSLNSQVTGLPLGTTLFVCKLACINSDEIQICGAEIFVGVAPEQPQNLSCIQKGEQGTVACTWERGRDTHLYTEYTLQLSGPKNLTWQKQCKDIYCDYLDFGINLTPESPESNFTAKVTAVNSLGSSSSLPSTFTFLDIVRPLPPWDIRIKFQKASVSRCTLYWRDEGLVLLNRLRYRPSNSRLWNMVNVTKAKGRHDLLDLKPFTEYEFQISSKLHLYKGSWSDWSESLRAQTPEEEPTGMLDVWYMKRHIDYSRQQISLFWKNLSVSEARGKILHYQVTLQELTGGKAMTQNITGHTSWTTVIPRTGNWAVAVSAANSKGSSLPTRINIMNLCEAGLLAPRQVSANSEGMDNILVTWQPPRKDPSAVQEYVVEWRELHPGGDTQVPLNWLRSRPYNVSALISENIKSYICYEIRVYALSGDQGGCSSILGNSKHKAPLSGPHINAITEEKGSILISWNSIPVQEQMGCLLHYRIYWKERDSNSQPQLCEIPYRVSQNSHPINSLQPRVTYVLWMTALTAAGESSHGNEREFCLQGKAN

SEQ ID NO: 9 - protein, 5 aa, Artificial Sequence
  Description of Artificial Sequence: Synthetic peptide
GGGGS

SEQ ID NO: 10 - protein, 10 aa, Artificial Sequence
  Description of Artificial Sequence: Synthetic peptide
GGGGSGGGGS

SEQ ID NO: 11 - protein, 15 aa, Artificial Sequence
  Description of Artificial Sequence: Synthetic peptide
GGGGSGGGGSGGGGS

SEQ ID NO: 12 - protein, 20 aa, Artificial Sequence
  Description of Artificial Sequence: Synthetic peptide
GGGGSGGGGSGGGGSGGGGS

SEQ ID NO: 13 - protein, 25 aa, Artificial Sequence
  Description of Artificial Sequence: Synthetic peptide
GGGGSGGGGSGGGGSGGGGSGGGGS

SEQ ID NO: 14 - protein, 30 aa, Artificial Sequence
  Description of Artificial Sequence: Synthetic polypeptide
GGGGSGGGGSGGGGSGGGGSGGGGSGGGGS

SEQ ID NO: 15 - protein, 35 aa, Artificial Sequence
  Description of Artificial Sequence: Synthetic polypeptide
GGGGSGGGGSGGGGSGGGGSGGGGSGGGGSGGGGS

SEQ ID NO: 16 - protein, 30 aa, Artificial Sequence
  Description of Artificial Sequence: Synthetic polypeptide
DPALVHQRPAPPGGGGSGGGGSGGGGSGGG

SEQ ID NO: 17 - protein, 5 aa, Artificial Sequence
  Description of Artificial Sequence: Synthetic peptide
GKPGS

SEQ ID NO: 18 - protein, 25 aa, Artificial Sequence
  Description of Artificial Sequence: Synthetic peptide
GKPGSGKPGSGKPGSGKPGSGKPGS

SEQ ID NO: 19 - protein, 30 aa, Artificial Sequence
  Description of Artificial Sequence: Synthetic polypeptide
GKPGSGKPGSGKPGSGKPGSGKPGSGKPGS

SEQ ID NO: 20 - protein, 5 aa, Artificial Sequence
  Description of Artificial Sequence: Synthetic peptide
GGGES

SEQ ID NO: 21 - protein, 231 aa, Artificial Sequence
  Description of Artificial Sequence: Synthetic polypeptide
  Backbone 1 monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 22 - protein, 231 aa, Artificial Sequence
  Description of Artificial Sequence: Synthetic polypeptide
  Backbone 1 monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 23 - protein, 231 aa, Artificial Sequence
  Description of Artificial Sequence: Synthetic polypeptide
  Backbone 2 monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 24 - protein, 231 aa, Artificial Sequence; identical to SEQ ID NO: 22
  Description of Artificial Sequence: Synthetic polypeptide
  Backbone monomer 2

SEQ ID NO: 25 - protein, 231 aa, Artificial Sequence; identical to SEQ ID NO: 23
  Description of Artificial Sequence: Synthetic polypeptide
  Backbone 3 monomer 1

SEQ ID NO: 26 - protein, 231 aa, Artificial Sequence
  Description of Artificial Sequence: Synthetic polypeptide
  Backbone 3 monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCEVSGFYPSDIAVEWESDGQPENNYKTTPPVLDSDGSFFLYSKLTVDKSRWEQGDVFSCSVMHEALHNHYTQKSLSLSPGK

SEQ ID NO: 27 - protein, 231 aa, Artificial Sequence
  Description of Artificial Sequence: Synthetic polypeptide
  Backbone 4 monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSKGSFFLYSKLTVDKSRWQQGNVFSCSVMHEALHNHYTQKSLSLSPGK

SEQ ID NO: 28 - protein, 231 aa, Artificial Sequence
  Description of Artificial Sequence: Synthetic polypeptide
  Backbone 4 monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTENEVSLTCLVKGFYPSDIAVEWESDGQPENNYKTTPPVLDSDGSFFLYSKLEVDKSRWEQGDVFSCSVMHEALHNHYTQKSLSLSPGK

SEQ ID NO: 29 - protein, 231 aa, Artificial Sequence
  Description of Artificial Sequence: Synthetic polypeptide
  Backbone 5 monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSRDQLTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 30 - protein, 231 aa, Artificial Sequence
  Description of Artificial Sequence: Synthetic polypeptide
  Backbone 5 monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSRDELTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 31 - protein, 231 aa, Artificial Sequence
  Description of Artificial Sequence: Synthetic polypeptide
  Backbone 6 monomer 1
EPKSSDKTHTCPPCPAPPVAGPSVFLFPPKPKDTLMISRTPEVTCVVVDVKHEDPEVKFNWYVDGVEVHNAKTKPREEQYASTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 32 - protein, 231 aa, Artificial Sequence
  Description of Artificial Sequence: Synthetic polypeptide
  Backbone 6 monomer 2
EPKSSDKTHTCPPCPAPPVAGPSVFLFPPKPKDTLMISRTPEVTCVVVDVKHEDPEVKFNWYVDGVEVHNAKTKPREEEYASTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 33 - protein, 231 aa, Artificial Sequence
  Description of Artificial Sequence: Synthetic polypeptide
  Backbone 7 monomer 1
EPKSSDKTHTCPPCPAPPVAGPSVFLFPPKPKDTLMISRTPEVTCVVVDVKHEDPEVKFNWYVDGVEVHNAKTKPREEQYSSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 34 - protein, 231 aa, Artificial Sequence
  Description of Artificial Sequence: Synthetic polypeptide
  Backbone 7 monomer 2
EPKSSDKTHTCPPCPAPPVAGPSVFLFPPKPKDTLMISRTPEVTCVVVDVKHEDPEVKFNWYVDGVEVHNAKTKPREEEYSSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 35 - protein, 229 aa, Artificial Sequence
  Description of Artificial Sequence: Synthetic polypeptide
  Backbone 8 monomer 1
ESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEQMTKNQVKLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 36 - protein, 229 aa, Artificial Sequence
  Description of Artificial Sequence: Synthetic polypeptide
  Backbone 8 monomer 2
ESKYGPPCPPCPAPEFLGGPSVFLFPPKPKDTLMISRTPEVTCVVVDVSQEDPEVQFNWYVDGVEVHNAKTKPREEEFNSTYRVVSVLTVLHQDWLNGKEYKCKVSNKGLPSSIEKTISKAKGQPREPQVYTLPPSQEEMTKNQVSLTCDVSGFYPSDIAVEWESDGQPENNYKTTPPVLDSDGSFFLYSRLTVDKSRWEEGDVFSCSVMHEALHNHYTQKSLSLSLGK

SEQ ID NO: 37 - protein, 228 aa, Artificial Sequence
  Description of Artificial Sequence: Synthetic polypeptide
  Backbone 9 monomer 1
ERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 38 - protein, 228 aa, Artificial Sequence
  Description of Artificial Sequence: Synthetic polypeptide
  Backbone 9 monomer 2
ERKCCVECPPCPAPPVAGPSVFLFPPKPKDTLMISRTPEVTCVVVDVSHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 39 - protein, 228 aa, Artificial Sequence
  Description of Artificial Sequence: Synthetic polypeptide
  Backbone 10 monomer 1
ERKCCVECPPCPAPPVAGPSVFLFPPKPKDTLMISRTPEVTCVVVDVKHEDPEVQFNWYVDGVEVHNAKTKPREEQFNSTFRVVSVLTVVHQDWLNGKEYKCKVSNKGLPAPIEKTISKTKGQPREPQVYTLPPSREQMTKNQVKLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 40 - protein, 228 aa, Artificial Sequence
  Description of Artificial Sequence: Synthetic polypeptide
  Backbone 10 monomer 2
ERKCCVECPPCPAPPVAGPSVFLFPPKPKDTLMISRTPEVTCVVVDVKHEDPEVQFNWYVDGVEVHNAKTKPREEEFNSTFRVVSVLTVVHQDWLNGKEYKCKVSNKGLPAPIEKTISKTKGQPREPQVYTLPPSREEMTKNQVSLTCDVSGFYPSDIAVEWESDGQPENNYKTTPPMLDSDGSFFLYSKLTVDKSRWEQGDVFSCSVMHEALHNHYTQKSLSLSPGK

SEQ ID NO: 41 - protein, 231 aa, Artificial Sequence
  Description of Artificial Sequence: Synthetic polypeptide
  Backbone 11 monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 42 - protein, 231 aa, Artificial Sequence
  Description of Artificial Sequence: Synthetic polypeptide
  Backbone 11 monomer 2
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 43 - protein, 231 aa, Artificial Sequence
  Description of Artificial Sequence: Synthetic polypeptide
  Backbone 12 monomer 1
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 44 - protein, 231 aa, Artificial Sequence; identical to SEQ ID NO: 43
  Description of Artificial Sequence: Synthetic polypeptide
  Backbone 12 monomer 2

SEQ ID NO: 45 - protein, 231 aa, Artificial Sequence; identical to SEQ ID NO: 22
  Description of Artificial Sequence: Synthetic polypeptide
  Backbone 13 monomer 1

SEQ ID NO: 46 - protein, 231 aa, Artificial Sequence
  Description of Artificial Sequence: Synthetic polypeptide
  Backbone 13 monomer 2
ERKSSDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 47 - protein, 547 aa, Artificial Sequence
  Description of Artificial Sequence: Synthetic polypeptide
  Chain 1 (XenD22914) - human_IL12p40_(GGGGS)2_Fc(216)_IgG1_ pI(-)_Isosteric_A_C220S/PVA_/S267K/L368D/K370S
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 48 - protein, 438 aa, Artificial Sequence
  Description of Artificial Sequence: Synthetic polypeptide
  XENP27201 Chain 2 - human_IL12p35_(GGGGS)2_Fc(216)_IgG1_ C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 49 - protein, 546 aa, Artificial Sequence
  Description of Artificial Sequence: Synthetic polypeptide
  XENP27202 Chain 1 - empty-Fc(216)_IgG1_pI(-)_Isosteric _A_C220S/PVA_/S267K/L368D/K370S_(GGGGS)2_human_IL12p40
EPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 50 - protein, 437 aa, Artificial Sequence
  Description of Artificial Sequence: Synthetic polypeptide
  XENP27202 Chain 2 - human_IL12p40-empty-Fc(216)_IgG1_ C220S/PVA_/S267K/S364K/E357Q_(GGGGS)2_human_IL12p35
EPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 51 - protein, 769 aa, Artificial Sequence
  Description of Artificial Sequence: Synthetic polypeptide
  Chain 1 - human_IL12p40_(GGGGS)5-human_IL12p35_(GGGGS)2 _(single-Chain)_Fc(216)_IgG1_pI(-)_Isosteric_A_C220S/ PVA_/S267K/L368D/K370S
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 52 - protein, 231 aa, Artificial Sequence; identical to SEQ ID NO: 21
  Description of Artificial Sequence: Synthetic polypeptide
  XENP27203 Chain 2 - empty-Fc(216)_IgG1_C220S/PVA_/S267K /S364K/E357Q

SEQ ID NO: 53 - protein, 769 aa, Artificial Sequence
  Description of Artificial Sequence: Synthetic polypeptide
  XENP27204 Chain 1 - human_IL12p35_(GGGGS)5-human_IL12p40 _(GGGGS)2_(single-Chain)_Fc(216)_IgG1_pI(-)_Isosteric _A_C220S/PVA_/S267K/L368D/K370S
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSGGGGSGGGGSGGGGSIWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 54 - protein, 231 aa, Artificial Sequence; identical to SEQ ID NO: 21
  Description of Artificial Sequence: Synthetic polypeptide
  XENP27204 Chain 2 - empty-Fc(216)_IgG1_C220S/PVA_/S267K/ S364K/E357Q

SEQ ID NO: 55 - protein, 547 aa, Artificial Sequence; identical to SEQ ID NO: 47
  Description of Artificial Sequence: Synthetic polypeptide
  XENP27560 human_IL12p40_(GGGGS)2-Fc(216)_IgG1_pI(-)_ Isosteric_A_C220S/PVA_/S267K/L368D/K370S_homodimer

SEQ ID NO: 56 - protein, 438 aa, Artificial Sequence; identical to SEQ ID NO: 48
  Description of Artificial Sequence: Synthetic polypeptide
  XENP27561 human_IL12p35_(GGGGS)2_Fc(216)_IgG1_C220S/PVA_/S267K/ S364K/E357Q_homodimer

SEQ ID NO: 57 - protein, 306 aa, Artificial Sequence
  Description of Artificial Sequence: Synthetic polypeptide
  IL-12p40(N103D)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKDKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 58 - protein, 306 aa, Artificial Sequence
  Description of Artificial Sequence: Synthetic polypeptide
  IL-12p40(N113D)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKDYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 59 - protein, 306 aa, Artificial Sequence
  Description of Artificial Sequence: Synthetic polypeptide
  IL-12p40(N200D)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEDYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 60 - protein, 306 aa, Artificial Sequence
  Description of Artificial Sequence: Synthetic polypeptide
  IL-12p40(N281D)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKDASISVRAQDRYYSSSWSEWASVPCS

SEQ ID NO: 61 - protein, 306 aa, Artificial Sequence
  Description of Artificial Sequence: Synthetic polypeptide
  IL-12p40(N103D/N113D/N200D/N281D)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKDKTFLRCEAKDYSGRFTCWWLTTISTDLTFSVKSSRGSSDPQGVTCGAATLSAERVRGDNKEYEYSVECQEDSACPAAEESLPIEVMVDAVHKLKYEDYTSSFFIRDIIKPDPPKNLQLKPLKNSRQVEVSWEYPDTWSTPHSYFSLTFCVQVQGKSKREKKDRVFTDKTSATVICRKDASISVRAQDRYYSSSWSEWASVPCS

SEQ ID NO: 62 - protein, 306 aa, Artificial Sequence
  Description of Artificial Sequence: Synthetic polypeptide
  IL-12p40(Q42E)
IWELKKDVYVVELDWYPDAPGEMVVLTCDTPEEDGITWTLDESSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 63 - protein, 306 aa, Artificial Sequence
  Description of Artificial Sequence: Synthetic polypeptide
  IL-12p40(E45Q)
IWELKKDVYVVELDWYPDAPGEMVVLTCDTPEEDGITWTLDQSSQVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 64 - protein, 306 aa, Artificial Sequence
  Description of Artificial Sequence: Synthetic polypeptide
  IL-12p40(Q56E)
IWELKKDVYVVELDWYPDAPGEMVVLTCDTPEEDGITWTLDQSSEVLGSGKTLTIEVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 65 - protein, 306 aa, Artificial Sequence
  Description of Artificial Sequence: Synthetic polypeptide
  IL-12p40(E59Q)
IWELKKDVYVVELDWYPDAPGEMVVLTCDTPEEDGITWTLDQSSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 66 - protein, 306 aa, Artificial Sequence
  Description of Artificial Sequence: Synthetic polypeptide
  IL-12p40(D62N)
IWELKKDVYVVELDWYPDAPGEMVVLTCDTPEEDGITWTLDQSSEVLGSGKTLTIQVKEFGNAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 67 - protein, 306 aa, Artificial Sequence
  Description of Artificial Sequence: Synthetic polypeptide
  IL-12p40(Q42E/E45Q)
IWELKKDVYVVELDWYPDAPGEMVVLTCDTPEEDGITWTLDESSQVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 68 - protein, 306 aa, Artificial Sequence
  Description of Artificial Sequence: Synthetic polypeptide
  IL-12p40(E45Q/Q56E)
IWELKKDVYVVELDWYPDAPGEMVVLTCDTPEEDGITWTLDQSSQVLGSGKTLTIEVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 69 - protein, 306 aa, Artificial Sequence
  Description of Artificial Sequence: Synthetic polypeptide
  IL-12p40(Q42E/E59Q)
IWELKKDVYVVELDWYPDAPGEMVVLTCDTPEEDGITWTLDESSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 70 - protein, 306 aa, Artificial Sequence
  Description of Artificial Sequence: Synthetic polypeptide
  IL-12p40(Q56E/E59Q)
IWELKKDVYVVELDWYPDAPGEMVVLTCDTPEEDGITWTLDQSSEVLGSGKTLTIEVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 71 - protein, 306 aa, Artificial Sequence
  Description of Artificial Sequence: Synthetic polypeptide
  IL-12p40(Q42E/E45Q/Q56E)
IWELKKDVYVVELDWYPDAPGEMVVLTCDTPEEDGITWTLDESSQVLGSGKTLTIEVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 72 - protein, 306 aa, Artificial Sequence
  Description of Artificial Sequence: Synthetic polypeptide
  IL-12p40(E45Q/Q56E/E59Q)
IWELKKDVYVVELDWYPDAPGEMVVLTCDTPEEDGITWTLDQSSQVLGSGKTLTIEVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 73 - protein, 306 aa, Artificial Sequence
  Description of Artificial Sequence: Synthetic polypeptide
  IL-12p40(D161N)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGNNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 74 - protein, 306 aa, Artificial Sequence
  Description of Artificial Sequence: Synthetic polypeptide
  IL-12p40(E73Q)
IWELKKDVYVVELDWYPDAPGEMVVLTCDTPEEDGITWTLDQSSEVLGSGKTLTIQVKEFGDAGQYTCHKGGQVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 75 - protein, 306 aa, Artificial Sequence
  Description of Artificial Sequence: Synthetic polypeptide
  IL-12p40(Q144E)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPEGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 76 - protein, 306 aa, Artificial Sequence
  Description of Artificial Sequence: Synthetic polypeptide
  IL-12p40(E262Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKRQKKDRVFTDKTSATVICRKNASISVRAQDRYYSSSWSEWASVPCS

SEQ ID NO: 77 - protein, 306 aa, Artificial Sequence
  Description of Artificial Sequence: Synthetic polypeptide
  IL-12p40(E100Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKQPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 78 - protein, 306 aa, Artificial Sequence
  Description of Artificial Sequence: Synthetic polypeptide
  IL-12p40(D18N)
IWELKKDVYVVELDWYPNAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 79 - protein, 306 aa, Artificial Sequence
  Description of Artificial Sequence: Synthetic polypeptide
  IL-12p40(E33Q)
IWELKKDVYVVELDWYPDAPGEMVVLTCDTPEQDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 80 - protein, 306 aa, Artificial Sequence
  Description of Artificial Sequence: Synthetic polypeptide
  IL-12p40(Q229E)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSREVEVSWEYPDTWSTPHSYFSLTFCVQVQGKSKREKKDRVFTDKTSATVICRKNASISVRAQDRYYSSSWSEWASVPCS

SEQ ID NO: 81 - protein, 306 aa, Artificial Sequence
  Description of Artificial Sequence: Synthetic polypeptide
  IL-12p40(E235Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWQYPDTWSTPHSYFSLTFCVQVQGKSKREKKDRVFTDKTSATVICRKNASISVRAQDRYYSSSWSEWASVPCS

SEQ ID NO: 82 - protein, 306 aa, Artificial Sequence
  Description of Artificial Sequence: Synthetic polypeptide
  IL-12p40(Q256N)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVNGKSKREKKDRVFTDKTSATVICRKNASISVRAQDRYYSSSWSEWASVPCS

SEQ ID NO: 83 - protein, 306 aa, Artificial Sequence
  Description of Artificial Sequence: Synthetic polypeptide
  IL-12p40(E299Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSQWASVPCS

SEQ ID NO: 84 - protein, 306 aa, Artificial Sequence
  Description of Artificial Sequence: Synthetic polypeptide
  IL-12p40(D87N)
IWELKKDVYVVELDWYPDAPGEMVVLTCDTPEEDGITWTLDQSSEVLGSGKTLTIQVKEFGDAGQYTCHKGGEVLSHSLLLLHKKENGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 85 - protein, 547 aa, Artificial Sequence
  Description of Artificial Sequence: Synthetic polypeptide
  XenD24752 human_IL12p40_N103D_(GGGGS)2-Fc(216)_IgG1 _pI(-)_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKDKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 86 - protein, 547 aa, Artificial Sequence
  Description of Artificial Sequence: Synthetic polypeptide
  XenD24753 human_IL12p40_N113D_(GGGGS)2-Fc(216)_IgG1_pI (-)_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKDYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 87 - protein, 547 aa, Artificial Sequence
  Description of Artificial Sequence: Synthetic polypeptide
  XenD24754 human_IL12p40_N200D_(GGGGS)2-Fc(216)_IgG1_pI (-)_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEDYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 88 - protein, 547 aa, Artificial Sequence
  Description of Artificial Sequence: Synthetic polypeptide
  XenD24755 human_IL12p40_N281D_(GGGGS)2-Fc(216)_IgG1_pI (-)_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKDASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 89 - protein, 547 aa, Artificial Sequence
  Description of Artificial Sequence: Synthetic polypeptide
  XenD24756 human_IL12p40_N103D/N113D/N200D/N281D_(GGGGS)2-Fc (216)_IgG1_pI(-)_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKDKTFLRCEAKDYSGRFTCWWLTTISTDLTFSVKSSRGSSDPQGVTCGAATLSAERVRGDNKEYEYSVECQEDSACPAAEESLPIEVMVDAVHKLKYEDYTSSFFIRDIIKPDPPKNLQLKPLKNSRQVEVSWEYPDTWSTPHSYFSLTFCVQVQGKSKREKKDRVFTDKTSATVICRKDASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 90 - protein, 547 aa, Artificial Sequence
  Description of Artificial Sequence: Synthetic polypeptide
  XenD24757 human_IL12p40_Q42E_(GGGGS)2-Fc(216)_IgG1_pI(- )_Isosteric_A_C220S/PVA_/S267K/L368D/K370S_pTT5
IWELKKDVYVVELDWYPDAPGEMVVLTCDTPEEDGITWTLDESSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 91 - protein, 547 aa, Artificial Sequence
  Description of Artificial Sequence: Synthetic polypeptide
  XenD24758 human_IL12p40_E45Q_(GGGGS)2-Fc(216)_IgG1_pI(- )_Isosteric_A_C220S/PVA_/S267K/L368D/K370S_pTT5
IWELKKDVYVVELDWYPDAPGEMVVLTCDTPEEDGITWTLDQSSQVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 92 - protein, 547 aa, Artificial Sequence
  Description of Artificial Sequence: Synthetic polypeptide
  XenD24759 human_IL12p40_Q56E_(GGGGS)2-Fc(216)_IgG1_pI(- )_Isosteric_A_C220S/PVA_/S267K/L368D/K370S_pTT5
IWELKKDVYVVELDWYPDAPGEMVVLTCDTPEEDGITWTLDQSSEVLGSGKTLTIEVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 93 - protein, 547 aa, Artificial Sequence
  Description of Artificial Sequence: Synthetic polypeptide
  Chain 1 (XenD24760) - human_IL12p40(E59Q)_(GGGGS)2_Fc(216) _IgG1_pI(-)_Isosteric_A_C220S/PVA_/S267K/L368D/K370S
IWELKKDVYVVELDWYPDAPGEMVVLTCDTPEEDGITWTLDQSSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 94 - protein, 547 aa, Artificial Sequence
  Description of Artificial Sequence: Synthetic polypeptide
  XenD24761 human_IL12p40_D62N_(GGGGS)2-Fc(216)_IgG1_pI(- )_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGNAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 95 - protein, 547 aa, Artificial Sequence
  Description of Artificial Sequence: Synthetic polypeptide
  XenD24762 human_IL12p40_Q42E/E45Q_(GGGGS)2-Fc(216)_IgG1_pI (-)_Isosteric_A_C220S/PVA_/S267K/L368D/K370S_pTT5
IWELKKDVYVVELDWYPDAPGEMVVLTCDTPEEDGITWTLDESSQVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 96 - protein, 547 aa, Artificial Sequence
  Description of Artificial Sequence: Synthetic polypeptide
  XenD24763 human_IL12p40_E45Q/Q56E_(GGGGS)2-Fc(216)_IgG1_pI (-)_Isosteric_A_C220S/PVA_/S267K/L368D/K370S_pTT5
IWELKKDVYVVELDWYPDAPGEMVVLTCDTPEEDGITWTLDQSSQVLGSGKTLTIEVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 97 - protein, 547 aa, Artificial Sequence
  Description of Artificial Sequence: Synthetic polypeptide
  XenD24764 human_IL12p40_Q42E/E59Q_(GGGGS)2-Fc(216)_IgG1_pI (-)_Isosteric_A_C220S/PVA_/S267K/L368D/K370S_pTT5
IWELKKDVYVVELDWYPDAPGEMVVLTCDTPEEDGITWTLDESSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 98 - protein, 547 aa, Artificial Sequence
  Description of Artificial Sequence: Synthetic polypeptide
  Chain 1 (XenD24765) - human_IL12p40(Q56E/E59Q)_(GGGGS)2_Fc (216)_IgG1_pI(-)_Isosteric_A_C220S/PVA_/S267K/L368D/K370S
IWELKKDVYVVELDWYPDAPGEMVVLTCDTPEEDGITWTLDQSSEVLGSGKTLTIEVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 99 - protein, 547 aa, Artificial Sequence
  Description of Artificial Sequence: Synthetic polypeptide
  XenD24766 human_IL12p40_Q42E/E45Q/Q56E_(GGGGS)2-Fc(216)_IgG1_ pI(-)_Isosteric_A_C220S/PVA_/S267K/L368D/K370S_pTT5
IWELKKDVYVVELDWYPDAPGEMVVLTCDTPEEDGITWTLDESSQVLGSGKTLTIEVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 100 - protein, 547 aa, Artificial Sequence
  Description of Artificial Sequence: Synthetic polypeptide
  XenD24767 human_IL12p40_E45Q/Q56E/E59Q_(GGGGS)2-Fc(216)_IgG1 _pI(-)_Isosteric_A_C220S/PVA_/S267K/L368D/K370S_pTT5
IWELKKDVYVVELDWYPDAPGEMVVLTCDTPEEDGITWTLDQSSQVLGSGKTLTIEVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 101 - protein, 547 aa, Artificial Sequence
  Description of Artificial Sequence: Synthetic polypeptide
  XenD24768 human_IL12p40_D161N_(GGGGS)2-Fc(216)_IgG1_pI (-)_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGNNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 102 - protein, 547 aa, Artificial Sequence
  Description of Artificial Sequence: Synthetic polypeptide
  XenD24769 human_IL12p40_E73Q_(GGGGS)2-Fc(216)_IgG1_pI( -)_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTCHKGGQVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 103 - protein, 547 aa, Artificial Sequence
  Description of Artificial Sequence: Synthetic polypeptide
  XenD24770 human_IL12p40_Q144E_(GGGGS)2-Fc(216)_IgG1_pI(- )_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPEGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 104 - protein, 547 aa, Artificial Sequence
  Description of Artificial Sequence: Synthetic polypeptide
  XenD24771 human_IL12p40_E262Q_(GGGGS)2-Fc(216)_IgG1_pI(- )_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKRQKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 105 - protein, 547 aa, Artificial Sequence
  Description of Artificial Sequence: Synthetic polypeptide
  XenD24772 human_IL12p40_E100Q_(GGGGS)2-Fc(216)_IgG1_pI(- )_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKQPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 106 - protein, 547 aa, Artificial Sequence
  Description of Artificial Sequence: Synthetic polypeptide
  XenD24773 human_IL12p40_D18N_(GGGGS)2-Fc(216)_IgG1_pI(- )_Isosteric_A_C220S/PVA_/S267K/L368D/K370S_pTT5
IWELKKDVYVVELDWYPNAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 107 - protein, 547 aa, Artificial Sequence
  Description of Artificial Sequence: Synthetic polypeptide
  XenD24774 human_IL12p40_E33Q_(GGGGS)2-Fc(216)_IgG1_pI(- )_Isosteric_A_C220S/PVA_/S267K/L368D/K370S_pTT5
IWELKKDVYVVELDWYPDAPGEMVVLTCDTPEQDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 108 - protein, 547 aa, Artificial Sequence
  Description of Artificial Sequence: Synthetic polypeptide
  XenD24775 human_IL12p40_Q229E_(GGGGS)2-Fc(216)_IgG1_pI(- )_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSREVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 109 - protein, 547 aa, Artificial Sequence
  Description of Artificial Sequence: Synthetic polypeptide
  XenD24776 human_IL12p40_E235Q_(GGGGS)2-Fc(216)_IgG1_pI(- )_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWQYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 110 - protein, 547 aa, Artificial Sequence
  Description of Artificial Sequence: Synthetic polypeptide
  XenD24777 human_IL12p40_Q256E_(GGGGS)2-Fc(216)_IgG1_pI(- )_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVEGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 111 - protein, 547 aa, Artificial Sequence
  Description of Artificial Sequence: Synthetic polypeptide
  XenD24778 human_IL12p40_E299Q_(GGGGS)2-Fc(216)_IgG1_pI(- )_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSQWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 112 - protein, 547 aa, Artificial Sequence
  Description of Artificial Sequence: Synthetic polypeptide
  XenD24792 human_IL12p40_D87N_(GGGGS)2-Fc(216)_IgG1_pI(- )_Isosteric_A_C220S/PVA_/S267K/L368D/K370S_pTT5
IWELKKDVYVVELDWYPDAPGEMVVLTCDTPEEDGITWTLDQSSEVLGSGKTLTIQVKEFGDAGQYTCHKGGEVLSHSLLLLHKKENGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 113 - protein, 197 aa, Artificial Sequence
  Description of Artificial Sequence: Synthetic polypeptide
  IL-12p35(N71D)
RNLPVATPDPGMFPCLHHSQNLLRAVSNMLQKARQTLEFYPCTSEEIDHEDITKDKTSTVEACLPLELTKDESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 114 - protein, 197 aa, Artificial Sequence
  Description of Artificial Sequence: Synthetic polypeptide
  IL-12p35(N85D)
RNLPVATPDPGMFPCLHHSQNLLRAVSNMLQKARQTLEFYPCTSEEIDHEDITKDKTSTVEACLPLELTKNESCLNSRETSFITDGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 115 - protein, 197 aa, Artificial Sequence
  Description of Artificial Sequence: Synthetic polypeptide
  IL-12p35(N195D)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLDAS

SEQ ID NO: 116 - protein, 197 aa, Artificial Sequence
  Description of Artificial Sequence: Synthetic polypeptide
  IL-12p35(N71D/N85D/N195D)
RNLPVATPDPGMFPCLHHSQNLLRAVSNMLQKARQTLEFYPCTSEEIDHEDITKDKTSTVEACLPLELTKDESCLNSRETSFITDGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLDAS

SEQ ID NO: 117 - protein, 197 aa, Artificial Sequence
  Description of Artificial Sequence: Synthetic polypeptide
  IL-12p35(E153Q)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSQTVPQKSSLEEPDFYKTKIKLCILLHAFRIRAVTIDRVMSYLNAS

SEQ ID NO: 118 - protein, 197 aa, Artificial Sequence
  Description of Artificial Sequence: Synthetic polypeptide
  IL-12p35(E38Q)
RNLPVATPDPGMFPCLHHSQNLLRAVSNMLQKARQTLQFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 119 - protein, 197 aa, Artificial Sequence
  Description of Artificial Sequence: Synthetic polypeptide
  IL-12p35(N151D)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFDSETVPQKSSLEEPDFYKTKIKLCILLHAFRIRAVTIDRVMSYLNAS

SEQ ID NO: 120 - protein, 197 aa, Artificial Sequence
  Description of Artificial Sequence: Synthetic polypeptide
  IL-12p35(Q135E)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDENMLAVIDELMQALNFNSETVPQKSSLEEPDFYKTKIKLCILLHAFRIRAVTIDRVMSYLNAS

SEQ ID NO: 121 - protein, 197 aa, Artificial Sequence
  Description of Artificial Sequence: Synthetic polypeptide
  IL-12p35(Q35D)
RNLPVATPDPGMFPCLHHSQNLLRAVSNMLQKARDTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 122 - protein, 197 aa, Artificial Sequence
  Description of Artificial Sequence: Synthetic polypeptide
  IL-12p35(Q146E)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMEALNFNSETVPQKSSLEEPDFYKTKIKLCILLHAFRIRAVTIDRVMSYLNAS

SEQ ID NO: 123 - protein, 197 aa, Artificial Sequence
  Description of Artificial Sequence: Synthetic polypeptide
  IL-12p35(N76D)
RNLPVATPDPGMFPCLHHSQNLLRAVSNMLQKARQTLEFYPCTSEEIDHEDITKDKTSTVEACLPLELTKNESCLDSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 124 - protein, 197 aa, Artificial Sequence
  Description of Artificial Sequence: Synthetic polypeptide
  IL-12p35(E162Q)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLQEPDFYKTKIKLCILLHAFRIRAVTIDRVMSYLNAS

SEQ ID NO: 125 - protein, 197 aa, Artificial Sequence
  Description of Artificial Sequence: Synthetic polypeptide
  IL-12p35(E163Q)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEQPDFYKTKIKLCILLHAFRIRAVTIDRVMSYLNAS

SEQ ID NO: 126 - protein, 438 aa, Artificial Sequence
  Description of Artificial Sequence: Synthetic polypeptide
  XenD24779 human_IL12p35_N71D_(GGGGS)2_Fc(216)_IgG1_C220S/PVA _/S267K/S364K/E357Q_pTT5
RNLPVATPDPGMFPCLHHSQNLLRAVSNMLQKARQTLEFYPCTSEEIDHEDITKDKTSTVEACLPLELTKDESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 127 - protein, 438 aa, Artificial Sequence
  Description of Artificial Sequence: Synthetic polypeptide
  XenD24780 human_IL12p35_N85D_(GGGGS)2_Fc(216)_IgG1_C220S/PVA_ /S267K/S364K/E357Q_pTT5
RNLPVATPDPGMFPCLHHSQNLLRAVSNMLQKARQTLEFYPCTSEEIDHEDITKDKTSTVEACLPLELTKNESCLNSRETSFITDGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 128 - protein, 438 aa, Artificial Sequence
  Description of Artificial Sequence: Synthetic polypeptide
  XenD24781 human_IL12p35_N195D_(GGGGS)2_Fc(216)_IgG1_C220S/PVA_ /S267K/S364K/E357Q_pTT5
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLDASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 129 - protein, 438 aa, Artificial Sequence
  Description of Artificial Sequence: Synthetic polypeptide
  XenD24782 human_IL12p35_N71D/N85D/N195D_(GGGGS)2_Fc(216)_ IgG1_C220S/PVA_/S267K/S364K/E357Q_pTT5
RNLPVATPDPGMFPCLHHSQNLLRAVSNMLQKARQTLEFYPCTSEEIDHEDITKDKTSTVEACLPLELTKDESCLNSRETSFITDGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLDASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 130 - protein, 438 aa, Artificial Sequence
  Description of Artificial Sequence: Synthetic polypeptide
  XenD24783 human_IL12p35_E153Q_(GGGGS)2_Fc(216)_IgG1_C220S/PVA _/S267K/S364K/E357Q_pTT5
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSQTVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 131 - protein, 438 aa, Artificial Sequence
  Description of Artificial Sequence: Synthetic polypeptide
  XenD24784 human_IL12p35_E38Q_(GGGGS)2_Fc(216)_IgG1_C220S/PVA_ /S267K/S364K/E357Q_pTT5
RNLPVATPDPGMFPCLHHSQNLLRAVSNMLQKARQTLQFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 132 - protein, 438 aa, Artificial Sequence
  Description of Artificial Sequence: Synthetic polypeptide
  Chain 2 (XenD24785) - human_IL12p35(N151D)_(GGGGS)2_Fc(216) _IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFDSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 133 - protein, 438 aa, Artificial Sequence
  Description of Artificial Sequence: Synthetic polypeptide
  XenD24786 human_IL12p35_Q135E_(GGGGS)2_Fc(216)_IgG1_C220S/ PVA_/S267K/S364K/E357Q_pTT5
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDENMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 134 - protein, 438 aa, Artificial Sequence
  Description of Artificial Sequence: Synthetic polypeptide
  XenD24787 human_IL12p35_Q35D_(GGGGS)2_Fc(216)_IgG1_C220S/PVA_ /S267K/S364K/E357Q_pTT5
RNLPVATPDPGMFPCLHHSQNLLRAVSNMLQKARDTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 135 - protein, 438 aa, Artificial Sequence
  Description of Artificial Sequence: Synthetic polypeptide
  XenD24788 human_IL12p35_Q146E_(GGGGS)2_Fc(216)_IgG1_C220S/PVA _/S267K/S364K/E357Q_pTT5
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMEALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 136 - protein, 438 aa, Artificial Sequence
  Description of Artificial Sequence: Synthetic polypeptide
  XenD24789 human_IL12p35_N76D_(GGGGS)2_Fc(216)_IgG1_C220S/PVA_ /S267K/S364K/E357Q_pTT5
RNLPVATPDPGMFPCLHHSQNLLRAVSNMLQKARQTLEFYPCTSEEIDHEDITKDKTSTVEACLPLELTKNESCLDSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 137 - protein, 438 aa, Artificial Sequence
  Description of Artificial Sequence: Synthetic polypeptide
  XenD24790 human_IL12p35_E162Q_(GGGGS)2_Fc(216)_IgG1_C220S/PVA_ /S267K/S364K/E357Q_pTT5
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLQEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 138 - protein, 438 aa, Artificial Sequence
  Description of Artificial Sequence: Synthetic polypeptide
  XenD24791 human_IL12p35_E163Q_(GGGGS)2_Fc(216)_IgG1_C220S/PVA _/S267K/S364K/E357Q_pTT5
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEQPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 139 - protein, 547 aa, Artificial Sequence; identical to SEQ ID NO: 89
  Description of Artificial Sequence: Synthetic polypeptide
  XENP28820 Chain 1 (XenD24756) - human_IL12p40_N103D/N113D/ N200D/N281D_(GGGGS)2-Fc(216)_IgG1_pI(-)_Isosteric_A_ C220S/PVA_/S267K/L368D/K370S

SEQ ID NO: 140 - protein, 438 aa, Artificial Sequence; identical to SEQ ID NO: 129
  Description of Artificial Sequence: Synthetic polypeptide
  XENP28820 Chain 2 (XenD24782) - human_IL12p35_N71D/N85D/N195D _(GGGGS)2_Fc(216)_IgG1_C220S/PVA_/S267K/S364K/E357Q

SEQ ID NO: 141 - protein, 547 aa, Artificial Sequence; identical to SEQ ID NO: 112
  Description of Artificial Sequence: Synthetic polypeptide
  XENP28821 Chain 1 (XenD24792) - human_IL12p40_D87N_(GGGGS) 2-Fc(216)_IgG1_pI(-)_Isosteric_A_C220S/PVA_/S267K/L368D/ K370S

SEQ ID NO: 142 - protein, 438 aa, Artificial Sequence; identical to SEQ ID NO: 48
  Description of Artificial Sequence: Synthetic polypeptide
  XENP28821 Chain 2 (XenD22915) - human_IL12p35_(GGGGS)2_Fc (216)_IgG1_C220S/PVA_/S267K/S364K/E357Q

SEQ ID NO: 143 - protein, 547 aa, Artificial Sequence; identical to SEQ ID NO: 90
  Description of Artificial Sequence: Synthetic polypeptide
  XENP28822 Chain 1 (XenD24757) - human_IL12p40_Q42E_(GGGGS) 2-Fc(216)_IgG1_pI(-)_Isosteric_A_C220S/PVA_/S267K/L368D/ K370S

SEQ ID NO: 144 - protein, 438 aa, Artificial Sequence; identical to SEQ ID NO: 48
  Description of Artificial Sequence: Synthetic polypeptide
  XENP28822 Chain 2 (XenD22915) - human_IL12p35_(GGGGS)2_Fc (216)_IgG1_C220S/PVA_/S267K/S364K/E357Q

SEQ ID NO: 145 - protein, 547 aa, Artificial Sequence; identical to SEQ ID NO: 91
  Description of Artificial Sequence: Synthetic polypeptide
  XENP28823 Chain 1 (XenD24758) - human_IL12p40_E45Q_(GGGGS)2 -Fc(216)_IgG1_pI(-)_Isosteric_A_C220S/PVA_/S267K/L368D/K370S

SEQ ID NO: 146 - protein, 438 aa, Artificial Sequence; identical to SEQ ID NO: 48
  Description of Artificial Sequence: Synthetic polypeptide
  XENP28823 Chain 2 (XenD22915) - human_IL12p35_(GGGGS)2_Fc (216)_IgG1_C220S/PVA_/S267K/S364K/E357Q

SEQ ID NO: 147 - protein, 547 aa, Artificial Sequence; identical to SEQ ID NO: 92
  Description of Artificial Sequence: Synthetic polypeptide
  XENP28824 Chain 1 (XenD24759) - human_IL12p40_Q56E_(GGGGS)2 -Fc(216)_IgG1_pI(-)_Isosteric_A_C220S/PVA_/S267K/L368D/K370S

SEQ ID NO: 148 - protein, 438 aa, Artificial Sequence; identical to SEQ ID NO: 48
  Description of Artificial Sequence: Synthetic polypeptide
  XENP28824 Chain 2 (XenD22915) - human_IL12p35_(GGGGS)2_Fc (216)_IgG1_C220S/PVA_/S267K/S364K/E357Q

SEQ ID NO: 149 - protein, 547 aa, Artificial Sequence; identical to SEQ ID NO: 93
  Description of Artificial Sequence: Synthetic polypeptide
  XENP28825 Chain 1 (XenD24760) - human_IL12p40_E59Q_(GGGGS)2 -Fc(216)_IgG1_pI(-)_Isosteric_A_C220S/PVA_/S267K/L368D/K370S

SEQ ID NO: 150 - protein, 438 aa, Artificial Sequence; identical to SEQ ID NO: 48
  Description of Artificial Sequence: Synthetic polypeptide
  XENP28825 Chain 2 (XenD22915) - human_IL12p35_(GGGGS)2_Fc (216)_IgG1_C220S/PVA_/S267K/S364K/E357Q

SEQ ID NO: 151 - protein, 547 aa, Artificial Sequence; identical to SEQ ID NO: 94
  Description of Artificial Sequence: Synthetic polypeptide
  XENP28826 Chain 1 (XenD24761) - human_IL12p40_D62N_(GGGGS)2 -Fc(216)_IgG1_pI(-)_Isosteric_A_C220S/PVA_/S267K/L368D/K370S

SEQ ID NO: 152 - protein, 438 aa, Artificial Sequence; identical to SEQ ID NO: 48
  Description of Artificial Sequence: Synthetic polypeptide
  XENP28826 Chain 2 (XenD22915) - human_IL12p35_(GGGGS)2_Fc (216)_IgG1_C220S/PVA_/S267K/S364K/E357Q

SEQ ID NO: 153 - protein, 547 aa, Artificial Sequence; identical to SEQ ID NO: 95
  Description of Artificial Sequence: Synthetic polypeptide
  XENP28827 Chain 1 (XenD24762) - human_IL12p40_Q42E/E45Q_(GGGGS)2 -Fc(216)_IgG1_pI(-)_Isosteric_A_C220S/PVA_/S267K/L368D/K370S

SEQ ID NO: 154 - protein, 438 aa, Artificial Sequence; identical to SEQ ID NO: 48
  Description of Artificial Sequence: Synthetic polypeptide
  XENP28827 Chain 2 (XenD22915) - human_IL12p35_(GGGGS)2_Fc (216)_IgG1_C220S/PVA_/S267K/S364K/E357Q

SEQ ID NO: 155 - protein, 547 aa, Artificial Sequence; identical to SEQ ID NO: 96
  Description of Artificial Sequence: Synthetic polypeptide
  XENP28828 Chain 1 (XenD24763) - human_IL12p40_E45Q/Q56E_(GGGGS) 2-Fc(216)_IgG1_pI(-)_Isosteric_A_C220S/PVA_/S267K/L368D/K370S

SEQ ID NO: 156 - protein, 438 aa, Artificial Sequence; identical to SEQ ID NO: 48
  Description of Artificial Sequence: Synthetic polypeptide
  XENP28828 Chain 2 (XenD22915) - human_IL12p35_(GGGGS)2_Fc (216)_IgG1_C220S/PVA_/S267K/S364K/E357Q

SEQ ID NO: 157 - protein, 547 aa, Artificial Sequence; identical to SEQ ID NO: 97
  Description of Artificial Sequence: Synthetic polypeptide
  XENP28829 Chain 1 (XenD24764) - human_IL12p40_Q42E/E59Q_(GGGGS) 2-Fc(216)_IgG1_pI(-)_Isosteric_A_C220S/PVA_/S267K/L368D/K370S

SEQ ID NO: 158 - protein, 438 aa, Artificial Sequence; identical to SEQ ID NO: 48
  Description of Artificial Sequence: Synthetic polypeptide
  XENP28829 Chain 2 (XenD22915) - human_IL12p35_(GGGGS)2_Fc (216)_IgG1_C220S/PVA_/S267K/S364K/E357Q

SEQ ID NO: 159 - protein, 547 aa, Artificial Sequence; identical to SEQ ID NO: 98
  Description of Artificial Sequence: Synthetic polypeptide
  XENP28830 Chain 1 (XenD24765) - human_IL12p40_Q56E/E59Q_(GGGGS) 2-Fc(216)_IgG1_pI(-)_Isosteric_A_C220S/PVA_/S267K/L368D/K370S

SEQ ID NO: 160 - protein, 438 aa, Artificial Sequence; identical to SEQ ID NO: 48
  Description of Artificial Sequence: Synthetic polypeptide
  XENP28830 Chain 2 (XenD22915) - human_IL12p35_(GGGGS)2_Fc (216)_IgG1_C220S/PVA_/S267K/S364K/E357Q

SEQ ID NO: 161 - protein, 547 aa, Artificial Sequence; identical to SEQ ID NO: 99
  Description of Artificial Sequence: Synthetic polypeptide
  XENP28831 Chain 1 (XenD24766) - human_IL12p40_Q42E/E45Q/Q56E_ (GGGGS)2-Fc(216)_IgG1_pI(-)_Isosteric_A_C220S/PVA_/S267K /L368D/K370S

SEQ ID NO: 162 - protein, 438 aa, Artificial Sequence; identical to SEQ ID NO: 48
  Description of Artificial Sequence: Synthetic polypeptide
  XENP28831 Chain 2 (XenD22915) - human_IL12p35_(GGGGS)2_Fc (216)_IgG1_C220S/PVA_/S267K/S364K/E357Q

SEQ ID NO: 163 - protein, 547 aa, Artificial Sequence; identical to SEQ ID NO: 100
  Description of Artificial Sequence: Synthetic polypeptide
  XENP28832 Chain 1 (XenD24767) - human_IL12p40_E45Q/Q56E/E59Q _(GGGGS)2-Fc(216)_IgG1_pI(-)_Isosteric_A_C220S/PVA_/S267K/ L368D/K370S

SEQ ID NO: 164 - protein, 438 aa, Artificial Sequence; identical to SEQ ID NO: 48
  Description of Artificial Sequence: Synthetic polypeptide
  XENP28832 Chain 2 (XenD22915) - human_IL12p35_(GGGGS)2_Fc (216)_IgG1_C220S/PVA_/S267K/S364K/E357Q

SEQ ID NO: 165 - protein, 547 aa, Artificial Sequence; identical to SEQ ID NO: 101
  Description of Artificial Sequence: Synthetic polypeptide
  XENP28833 Chain 1 (XenD24768) - human_IL12p40_D161N_(GGGGS) 2-Fc(216)_IgG1_pI(-)_Isosteric_A_C220S/PVA_/S267K/L368D /K370S

SEQ ID NO: 166 - protein, 438 aa, Artificial Sequence; identical to SEQ ID NO: 48
  Description of Artificial Sequence: Synthetic polypeptide
  XENP28833 Chain 2 (XenD22915) - human_IL12p35_(GGGGS)2_Fc (216)_IgG1_C220S/PVA_/S267K/S364K/E357Q

SEQ ID NO: 167 - protein, 547 aa, Artificial Sequence; identical to SEQ ID NO: 102
  Description of Artificial Sequence: Synthetic polypeptide
  XENP28834 Chain 1 (XenD24769) - human_IL12p40_E73Q_(GGGGS)2 -Fc(216)_IgG1_pI(-)_Isosteric_A_C220S/PVA_/S267K/L368D /K370S

SEQ ID NO: 168 - protein, 438 aa, Artificial Sequence; identical to SEQ ID NO: 48
  Description of Artificial Sequence: Synthetic polypeptide
  XENP28834 Chain 2 (XenD22915) - human_IL12p35_(GGGGS)2_Fc (216)_IgG1_C220S/PVA_/S267K/S364K/E357Q

SEQ ID NO: 169 - protein, 547 aa, Artificial Sequence; identical to SEQ ID NO: 103
  Description of Artificial Sequence: Synthetic polypeptide
  XENP28835 Chain 1 (XenD24770) - human_IL12p40_Q144E_(GGGGS)2 -Fc(216)_IgG1_pI(-)_Isosteric_A_C220S/PVA_/S267K/L368D/K370S

SEQ ID NO: 170 - protein, 438 aa, Artificial Sequence; identical to SEQ ID NO: 48
  Description of Artificial Sequence: Synthetic polypeptide
  XENP28835 Chain 2 (XenD22915) - human_IL12p35_(GGGGS)2_Fc (216)_IgG1_C220S/PVA_/S267K/S364K/E357Q

SEQ ID NO: 171 - protein, 547 aa, Artificial Sequence; identical to SEQ ID NO: 104
  Description of Artificial Sequence: Synthetic polypeptide
  XENP28836 Chain 1 (XenD24771) - human_IL12p40_E262Q_(GGGGS)2 -Fc(216)_IgG1_pI(-)_Isosteric_A_C220S/PVA_/S267K/L368D/K370S

SEQ ID NO: 172 - protein, 438 aa, Artificial Sequence; identical to SEQ ID NO: 48
  Description of Artificial Sequence: Synthetic polypeptide
  XENP28836 Chain 2 (XenD22915) - human_IL12p35_(GGGGS)2_Fc (216)_IgG1_C220S/PVA_/S267K/S364K/E357Q

SEQ ID NO: 173 - protein, 547 aa, Artificial Sequence; identical to SEQ ID NO: 105
  Description of Artificial Sequence: Synthetic polypeptide
  XENP28837 Chain 1 (XenD24772) - human_IL12p40_E100Q_(GGGGS)2 -Fc(216)_IgG1_pI(-)_Isosteric_A_C220S/PVA_/S267K/L368D/K370S

SEQ ID NO: 174 - protein, 438 aa, Artificial Sequence; identical to SEQ ID NO: 48
  Description of Artificial Sequence: Synthetic polypeptide
  XENP28837 Chain 2 (XenD22915) - human_IL12p35_(GGGGS)2_Fc (216)_IgG1_C220S/PVA_/S267K/S364K/E357Q

SEQ ID NO: 175 - protein, 547 aa, Artificial Sequence; identical to SEQ ID NO: 106
  Description of Artificial Sequence: Synthetic polypeptide
  XENP28838 Chain 1 (XenD24773) - human_IL12p40_D18N_(GGGGS)2 -Fc(216)_IgG1_pI(-)_Isosteric_A_C220S/PVA_/S267K/L368D /K370S

SEQ ID NO: 176 - protein, 438 aa, Artificial Sequence; identical to SEQ ID NO: 48
  Description of Artificial Sequence: Synthetic polypeptide
  XENP28838 Chain 2 (XenD22915) - human_IL12p35_(GGGGS)2_Fc (216)_IgG1_C220S/PVA_/S267K/S364K/E357Q

SEQ ID NO: 177 - protein, 547 aa, Artificial Sequence; identical to SEQ ID NO: 107
  Description of Artificial Sequence: Synthetic polypeptide
  XENP28839 Chain 1 (XenD24774) - human_IL12p40_E33Q_(GGGGS)2 -Fc(216)_IgG1_pI(-)_Isosteric_A_C220S/PVA_/S267K/L368D /K370S

SEQ ID NO: 178 - protein, 438 aa, Artificial Sequence; identical to SEQ ID NO: 48
  Description of Artificial Sequence: Synthetic polypeptide
  XENP28839 Chain 2 (XenD22915) - human_IL12p35_(GGGGS)2_Fc (216)_IgG1_C220S/PVA_/S267K/S364K/E357Q

SEQ ID NO: 179 - protein, 547 aa, Artificial Sequence; identical to SEQ ID NO: 108
  Description of Artificial Sequence: Synthetic polypeptide
  XENP28840 Chain 1 (XenD24775) - human_IL12p40_Q229E_(GGGGS)2 -Fc(216)_IgG1_pI(-)_Isosteric_A_C220S/PVA_/S267K/L368D/K370S

SEQ ID NO: 180 - protein, 438 aa, Artificial Sequence; identical to SEQ ID NO: 48
  Description of Artificial Sequence: Synthetic polypeptide
  XENP28840 Chain 2 (XenD22915) - human_IL12p35_(GGGGS)2_Fc (216)_IgG1_C220S/PVA_/S267K/S364K/E357Q

SEQ ID NO: 181 - protein, 547 aa, Artificial Sequence; identical to SEQ ID NO: 109
  Description of Artificial Sequence: Synthetic polypeptide
  XENP28841 Chain 1 (XenD24776) - human_IL12p40_E235Q_(GGGGS)2 -Fc(216)_IgG1_pI(-)_Isosteric_A_C220S/PVA_/S267K/L368D/K370S

SEQ ID NO: 182 - protein, 438 aa, Artificial Sequence; identical to SEQ ID NO: 48
  Description of Artificial Sequence: Synthetic polypeptide
  XENP28841 Chain 2 (XenD22915) - human_IL12p35_(GGGGS)2_Fc (216)_IgG1_C220S/PVA_/S267K/S364K/E357Q

SEQ ID NO: 183 - protein, 547 aa, Artificial Sequence; identical to SEQ ID NO: 110
  Description of Artificial Sequence: Synthetic polypeptide
  XENP28842 Chain 1 (XenD24777) - human_IL12p40_Q256E_(GGGGS)2 -Fc(216)_IgG1_pI(-)_Isosteric_A_C220S/PVA_/S267K/L368D/K370S

SEQ ID NO: 184 - protein, 438 aa, Artificial Sequence; identical to SEQ ID NO: 48
  Description of Artificial Sequence: Synthetic polypeptide
  XENP28842 Chain 2 (XenD22915) - human_IL12p35_(GGGGS)2_Fc (216)_IgG1_C220S/PVA_/S267K/S364K/E357Q

SEQ ID NO: 185 - protein, 547 aa, Artificial Sequence; identical to SEQ ID NO: 111
  Description of Artificial Sequence: Synthetic polypeptide
  XENP28843 Chain 1 (XenD24778) - human_IL12p40_E299Q_(GGGGS)2 -Fc(216)_IgG1_pI(-)_Isosteric_A_C220S/PVA_/S267K/L368D/K370S

SEQ ID NO: 186 - protein, 438 aa, Artificial Sequence; identical to SEQ ID NO: 48
  Description of Artificial Sequence: Synthetic polypeptide
  XENP28843 Chain 2 (XenD22915) - human_IL12p35_(GGGGS)2_Fc (216)_IgG1_C220S/PVA_/S267K/S364K/E357Q

SEQ ID NO: 187 - protein, 547 aa, Artificial Sequence; identical to SEQ ID NO: 47
  Description of Artificial Sequence: Synthetic polypeptide
  XENP28844 Chain 1 (XenD22914) - human_IL12p40_(GGGGS)2-Fc (216)_IgG1_pI(-)_Isosteric_A_C220S/PVA_/S267K/L368D/K370S

SEQ ID NO: 188 - protein, 438 aa, Artificial Sequence; identical to SEQ ID NO: 130
  Description of Artificial Sequence: Synthetic polypeptide
  XENP28844 Chain 2 (XenD24783) - human_IL12p35_E153Q_(GGGGS)2 _Fc(216)_IgG1_C220S/PVA_/S267K/S364K/E357Q

SEQ ID NO: 189 - protein, 547 aa, Artificial Sequence; identical to SEQ ID NO: 47
  Description of Artificial Sequence: Synthetic polypeptide
  XENP28845 Chain 1 (XenD22914) - human_IL12p40_(GGGGS)2-Fc (216)_IgG1_pI(-)_Isosteric_A_C220S/PVA_/S267K/L368D/K370S

SEQ ID NO: 190 - protein, 438 aa, Artificial Sequence; identical to SEQ ID NO: 131
  Description of Artificial Sequence: Synthetic polypeptide
  XENP28845 Chain 2 (XenD24784) - human_IL12p35_E38Q_(GGGGS)2_Fc (216)_IgG1_C220S/PVA_/S267K/S364K/E357Q

SEQ ID NO: 191 - protein, 547 aa, Artificial Sequence; identical to SEQ ID NO: 47
  Description of Artificial Sequence: Synthetic polypeptide
  XENP28846 Chain 1 (XenD22914) - human_IL12p40_(GGGGS)2-Fc (216)_IgG1_pI(-)_Isosteric_A_C220S/PVA_/S267K/L368D/K370S

SEQ ID NO: 192 - protein, 438 aa, Artificial Sequence; identical to SEQ ID NO: 132
  Description of Artificial Sequence: Synthetic polypeptide
  XENP28846 Chain 2 (XenD24785) - human_IL12p35_N151D_(GGGGS)2_Fc (216)_IgG1_C220S/PVA_/S267K/S364K/E357Q

SEQ ID NO: 193 - protein, 547 aa, Artificial Sequence; identical to SEQ ID NO: 47
  Description of Artificial Sequence: Synthetic polypeptide
  XENP28847 Chain 1 (XenD22914) - human_IL12p40_(GGGGS)2-Fc (216)_IgG1_pI(-)_Isosteric_A_C220S/PVA_/S267K/L368D/K370S

SEQ ID NO: 194 - protein, 438 aa, Artificial Sequence; identical to SEQ ID NO: 133
  Description of Artificial Sequence: Synthetic polypeptide
  XENP28847 Chain 2 (XenD24786) - human_IL12p35_Q135E_(GGGGS)2_Fc (216)_IgG1_C220S/PVA_/S267K/S364K/E357Q

SEQ ID NO: 195 - protein, 547 aa, Artificial Sequence; identical to SEQ ID NO: 47
  Description of Artificial Sequence: Synthetic polypeptide
  XENP28848 Chain 1 (XenD22914) - human_IL12p40_(GGGGS)2-Fc (216)_IgG1_pI(-)_Isosteric_A_C220S/PVA_/S267K/L368D/K370S

SEQ ID NO: 196 - protein, 438 aa, Artificial Sequence; identical to SEQ ID NO: 134
  Description of Artificial Sequence: Synthetic polypeptide
  XENP28848 Chain 2 (XenD24787) - human_IL12p35_Q35D_(GGGGS)2_Fc (216)_IgG1_C220S/PVA_/S267K/S364K/E357Q

SEQ ID NO: 197 - protein, 547 aa, Artificial Sequence; identical to SEQ ID NO: 47
  Description of Artificial Sequence: Synthetic polypeptide
  XENP28849 Chain 1 (XenD22914) - human_IL12p40_(GGGGS)2-Fc (216)_IgG1_pI(-)_Isosteric_A_C220S/PVA_/S267K/L368D/K370S

SEQ ID NO: 198 - protein, 438 aa, Artificial Sequence; identical to SEQ ID NO: 135
  Description of Artificial Sequence: Synthetic polypeptide
  XENP28849 Chain 2 (XenD24788) - human_IL12p35_Q146E_(GGGGS)2_Fc (216)_IgG1_C220S/PVA_/S267K/S364K/E357Q

SEQ ID NO: 199 - protein, 547 aa, Artificial Sequence; identical to SEQ ID NO: 47
  Description of Artificial Sequence: Synthetic polypeptide
  XENP28850 Chain 1 (XenD22914) - human_IL12p40_(GGGGS)2-Fc (216)_IgG1_pI(-)_Isosteric_A_C220S/PVA_/S267K/L368D/K370S

SEQ ID NO: 200 - protein, 438 aa, Artificial Sequence; identical to SEQ ID NO: 136
  Description of Artificial Sequence: Synthetic polypeptide
  XENP28850 Chain 2 (XenD24789) - human_IL12p35_N76D_(GGGGS)2_Fc (216)_IgG1_C220S/PVA_/S267K/S364K/E357Q

SEQ ID NO: 201 - protein, 547 aa, Artificial Sequence; identical to SEQ ID NO: 47
  Description of Artificial Sequence: Synthetic polypeptide
  XENP28851 Chain 1 (XenD22914) - human_IL12p40_(GGGGS)2-Fc (216)_IgG1_pI(-)_Isosteric_A_C220S/PVA_/S267K/L368D/K370S

SEQ ID NO: 202 - protein, 438 aa, Artificial Sequence; identical to SEQ ID NO: 137
  Description of Artificial Sequence: Synthetic polypeptide
  XENP28851 Chain 2 (XenD24790) - human_IL12p35_E162Q_(GGGGS)2_Fc (216)_IgG1_C220S/PVA_/S267K/S364K/E357Q

SEQ ID NO: 203 - protein, 547 aa, Artificial Sequence; identical to SEQ ID NO: 47
  Description of Artificial Sequence: Synthetic polypeptide
  XENP28852 Chain 1 (XenD22914) - human_IL12p40_(GGGGS)2-Fc (216)_IgG1_pI(-)_Isosteric_A_C220S/PVA_/S267K/L368D/K370S

SEQ ID NO: 204 - protein, 438 aa, Artificial Sequence; identical to SEQ ID NO: 138
  Description of Artificial Sequence: Synthetic polypeptide
  XENP28852 Chain 2 (XenD24791) - human_IL12p35_E163Q_(GGGGS)2_Fc (216)_IgG1_C220S/PVA_/S267K/S364K/E357Q

SEQ ID NO: 205 - protein, 306 aa, Artificial Sequence
  Description of Artificial Sequence: Synthetic polypeptide
  IL12p40(E59K)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 206 - protein, 306 aa, Artificial Sequence
  Description of Artificial Sequence: Synthetic polypeptide
  IL12p40(E32Q/E59Q)
IWELKKDVYVVELDWYPDAPGEMVVLTCDTPQEDGITWTLDQSSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 207 - protein, 306 aa, Artificial Sequence
  Description of Artificial Sequence: Synthetic polypeptide
  IL12p40(D34N/E59Q)
IWELKKDVYVVELDWYPDAPGEMVVLTCDTPEENGITWTLDQSSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 208 - protein, 306 aa, Artificial Sequence
  Description of Artificial Sequence: Synthetic polypeptide
  IL12p40(E59Q/E187Q)
IWELKKDVYVVELDWYPDAPGEMVVLTCDTPEEDGITWTLDQSSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIQVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 209 - protein, 306 aa, Artificial Sequence
  Description of Artificial Sequence: Synthetic polypeptide
  IL12p40(S43E/E59Q)
IWELKKDVYVVELDWYPDAPGEMVVLTCDTPEEDGITWTLDQESEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 210 - protein, 306 aa, Artificial Sequence
  Description of Artificial Sequence: Synthetic polypeptide
  IL12p40(S43K/E59Q)
IWELKKDVYVVELDWYPDAPGEMVVLTCDTPEEDGITWTLDQKSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 211 - protein, 306 aa, Artificial Sequence
  Description of Artificial Sequence: Synthetic polypeptide
  IL12p40(E59Q/K163E)
IWELKKDVYVVELDWYPDAPGEMVVLTCDTPEEDGITWTLDQSSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNEEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 212 - protein, 306 aa, Artificial Sequence
  Description of Artificial Sequence: Synthetic polypeptide
  IL12p40(E59Q/K99E)
IWELKKDVYVVELDWYPDAPGEMVVLTCDTPEEDGITWTLDQSSEVLGSGKTLTIQVKQFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 213 - protein, 306 aa, Artificial Sequence
  Description of Artificial Sequence: Synthetic polypeptide
  IL12p40(E59Q/K258E)
IWELKKDVYVVELDWYPDAPGEMVVLTCDTPEEDGITWTLDQSSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGESKREKKDRVFTDKTSATVICRKNASISVRAQDRYYSSSWSEWASVPCS

SEQ ID NO: 214 - protein, 306 aa, Artificial Sequence
  Description of Artificial Sequence: Synthetic polypeptide
  IL12p40(E59Q/K260E)
IWELKKDVYVVELDWYPDAPGEMVVLTCDTPEEDGITWTLDQSSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSEREKKDRVFTDKTSATVICRKNASISVRAQDRYYSSSWSEWASVPCS

SEQ ID NO: 215 - protein, 547 aa, Artificial Sequence
  Description of Artificial Sequence: Synthetic polypeptide
  Chain 1 (XenD25922) - human_IL12p40(E59K)_(GGGGS)2_Fc(216) _IgG1_pI(-)_Isosteric_A_C220S/PVA_/S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 216 - protein, 547 aa, Artificial Sequence
  Description of Artificial Sequence: Synthetic polypeptide
  Chain 1 (XenD25923) - human_IL12p40(E32Q/E59Q)_(GGGGS)2_Fc(216) _IgG1_pI(-)_Isosteric_A_C220S/PVA_/S267K/L368D/K370S
IWELKKDVYVVELDWYPDAPGEMVVLTCDTPQEDGITWTLDQSSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 217 - protein, 547 aa, Artificial Sequence
  Description of Artificial Sequence: Synthetic polypeptide
  Chain 1 (XenD25924) - human_IL12p40(D34N/E59Q)_(GGGGS)2_Fc(216) _IgG1_pI(-)_Isosteric_A_C220S/PVA_/S267K/L368D/K370S
IWELKKDVYVVELDWYPDAPGEMVVLTCDTPEENGITWTLDQSSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 218 - protein, 547 aa, Artificial Sequence
  Description of Artificial Sequence: Synthetic polypeptide
  Chain 1 (XenD25925) - human_IL12p40(E59Q/E187Q)_(GGGGS)2_Fc(216) _IgG1_pI(-)_Isosteric_A_C220S/PVA_/S267K/L368D/K370S
IWELKKDVYVVELDWYPDAPGEMVVLTCDTPEEDGITWTLDQSSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIQVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 219 - protein, 547 aa, Artificial Sequence
  Description of Artificial Sequence: Synthetic polypeptide
  Chain 1 (XenD25926) - human_IL12p40(S43E/E59Q)_(GGGGS)2_Fc(216) _IgG1_pI(-)_Isosteric_A_C220S/PVA_/S267K/L368D/K370S
IWELKKDVYVVELDWYPDAPGEMVVLTCDTPEEDGITWTLDQESEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 220 - protein, 547 aa, Artificial Sequence
  Description of Artificial Sequence: Synthetic polypeptide
  Chain 1 (XenD25927) - human_IL12p40(S43K/E59Q)_(GGGGS)2_Fc(216) _IgG1_pI(-)_Isosteric_A_C220S/PVA_/S267K/L368D/K370S
IWELKKDVYVVELDWYPDAPGEMVVLTCDTPEEDGITWTLDQKSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 221 - protein, 547 aa, Artificial Sequence
  Description of Artificial Sequence: Synthetic polypeptide
  Chain 1 (XenD25928) - human_IL12p40(E59Q/K163E)_(GGGGS)2_Fc(216) _IgG1_pI(-)_Isosteric_A_C220S/PVA_/S267K/L368D/K370S
IWELKKDVYVVELDWYPDAPGEMVVLTCDTPEEDGITWTLDQSSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNEEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 222 - protein, 547 aa, Artificial Sequence
  Description of Artificial Sequence: Synthetic polypeptide
  Chain 1 (XenD25929) - human_IL12p40(E59Q/K99E)_(GGGGS)2_Fc(216) _IgG1_pI(-)_Isosteric_A_C220S/PVA_/S267K/L368D/K370S
IWELKKDVYVVELDWYPDAPGEMVVLTCDTPEEDGITWTLDQSSEVLGSGKTLTIQVKQFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 223 - protein, 547 aa, Artificial Sequence
  Description of Artificial Sequence: Synthetic polypeptide
  Chain 1 (XenD25930) - human_IL12p40(E59Q/K258E)_(GGGGS)2_Fc(216) _IgG1_pI(-)_Isosteric_A_C220S/PVA_/S267K/L368D/K370S
IWELKKDVYVVELDWYPDAPGEMVVLTCDTPEEDGITWTLDQSSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGESKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 224 - protein, 547 aa, Artificial Sequence
  Description of Artificial Sequence: Synthetic polypeptide
  Chain 1 (XenD25931) - human_IL12p40(E59Q/K260E)_(GGGGS)2_Fc(216) _IgG1_pI(-)_Isosteric_A_C220S/PVA_/S267K/L368D/K370S
IWELKKDVYVVELDWYPDAPGEMVVLTCDTPEEDGITWTLDQSSEVLGSGKTLTIQVKQFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSEREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 225 - protein, 197 aa, Artificial Sequence
  Description of Artificial Sequence: Synthetic polypeptide
  IL12p35(N151D/E153Q)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFDSQTVPQKSSLEEPDFYKTKIKLCILLHAFRIRAVTIDRVMSYLNAS

SEQ ID NO: 226 - protein, 197 aa, Artificial Sequence
  Description of Artificial Sequence: Synthetic polypeptide
  IL12p35(E153K)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSKTVPQKSSLEEPDFYKTKIKLCILLHAFRIRAVTIDRVMSYLNAS

SEQ ID NO: 227 - protein, 197 aa, Artificial Sequence
  Description of Artificial Sequence: Synthetic polypeptide
  IL12p35(N151K)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFKSETVPQKSSLEEPDFYKTKIKLCILLHAFRIRAVTIDRVMSYLNAS

SEQ ID NO: 228 - protein, 197 aa, Artificial Sequence
  Description of Artificial Sequence: Synthetic polypeptide
  IL12p35(N151D/D165N)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFDSETVPQKSSLEEPNFYKTKIKLCILLHAFRIRAVTIDRVMSYLNAS

SEQ ID NO: 229 - protein, 197 aa, Artificial Sequence
  Description of Artificial Sequence: Synthetic polypeptide
  IL12p35(Q130E/N151D)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKREIFLDQNMLAVIDELMQALNFDSETVPQKSSLEEPDFYKTKIKLCILLHAFRIRAVTIDRVMSYLNAS

SEQ ID NO: 230 - protein, 197 aa, Artificial Sequence
  Description of Artificial Sequence: Synthetic polypeptide
  IL12p35(N151D/K158E)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFDSETVPQESSLEEPDFYKTKIKLCILLHAFRIRAVTIDRVMSYLNAS

SEQ ID NO: 231 - protein, 197 aa, Artificial Sequence
  Description of Artificial Sequence: Synthetic polypeptide
  IL12p35(E79Q/N151D)
RNLPVATPDPGMFPCLHHSQNLLRAVSNMLQKARQTLEFYPCTSEEIDHEDITKDKTSTVEACLPLELTKNESCLNSRQTSFITNGSCLASRKTSFMMALCLSSIYEDLKMYQVEFKTMNAKLLMDPKRQIFLDQNMLAVIDELMQALNFDSETVPQKSSLEEPDFYKTKIKLCILLHAFRIRAVTIDRVMSYLNAS

SEQ ID NO: 232 - protein, 197 aa, Artificial Sequence
  Description of Artificial Sequence: Synthetic polypeptide
  IL12p35(D55Q/N151D)
RNLPVATPDPGMFPCLHHSQNLLRAVSNMLQKARQTLEFYPCTSEEIDHEDITKQKTSTVEACLPLELTKNESCLNSRETSFITNGSCLASRKTSFMMALCLSSIYEDLKMYQVEFKTMNAKLLMDPKRQIFLDQNMLAVIDELMQALNFDSETVPQKSSLEEPDFYKTKIKLCILLHAFRIRAVTIDRVMSYLNAS

SEQ ID NO: 233 - protein, 197 aa, Artificial Sequence
  Description of Artificial Sequence: Synthetic polypeptide
  IL12p35(N136D/N151D)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQDMLAVIDELMQALNFDSETVPQKSSLEEPDFYKTKIKLCILLHAFRIRAVTIDRVMSYLNAS

SEQ ID NO: 234 - protein, 197 aa, Artificial Sequence
  Description of Artificial Sequence: Synthetic polypeptide
  IL12p35(N21D/N151D)
RNLPVATPDPGMFPCLHHSQDLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFDSETVPQKSSLEEPDFYKTKIKLCILLHAFRIRAVTIDRVMSYLNAS

SEQ ID NO: 235 - protein, 197 aa, Artificial Sequence
  Description of Artificial Sequence: Synthetic polypeptide
  IL12p35(E143Q/N151D)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDQLMQALNFDSETVPQKSSLEEPDFYKTKIKLCILLHAFRIRAVTIDRVMSYLNAS

SEQ ID NO: 236 - protein, 438 aa, Artificial Sequence
  Description of Artificial Sequence: Synthetic polypeptide
  Chain 2 (XenD25911) - human_IL12p35(N151D/E153Q)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFDSQTVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 237 - protein, 438 aa, Artificial Sequence
  Description of Artificial Sequence: Synthetic polypeptide
  Chain 2 (XenD25912) - human_IL12p35(E153K)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSKTVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 238 - protein, 438 aa, Artificial Sequence
  Description of Artificial Sequence: Synthetic polypeptide
  Chain 2 (XenD25913) - human_IL12p35(N151K)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFKSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 239 - protein, 438 aa, Artificial Sequence
  Description of Artificial Sequence: Synthetic polypeptide
  Chain 2 (XenD25914) - human_IL12p35(N151D/D165N)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFDSETVPQKSSLEEPNFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 240 - protein, 438 aa, Artificial Sequence
  Description of Artificial Sequence: Synthetic polypeptide
  Chain 2 (XenD25915) - human_IL12p35(Q130E/N151D)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKREIFLDQNMLAVIDELMQALNFDSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 241 - protein, 438 aa, Artificial Sequence
  Description of Artificial Sequence: Synthetic polypeptide
  Chain 2 (XenD25916) - human_IL12p35(N151D/K158E)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFDSETVPQESSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 242 - protein, 438 aa, Artificial Sequence
  Description of Artificial Sequence: Synthetic polypeptide
  Chain 2 (XenD25917) - human_IL12p35(E79Q/N151D)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRQTSFITNGSCLASRKTSFMMALCLSSIYEDLKMYQVEFKTMNAKLLMDPKRQIFLDQNMLAVIDELMQALNFDSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 243 - protein, 438 aa, Artificial Sequence
  Description of Artificial Sequence: Synthetic polypeptide
  Chain 2 (XenD25918) - human_IL12p35(D55Q/N151D)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKQKTSTVEACLPLELTKNESCLNSRETSFITNGSCLASRKTSFMMALCLSSIYEDLKMYQVEFKTMNAKLLMDPKRQIFLDQNMLAVIDELMQALNFDSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 244 - protein, 438 aa, Artificial Sequence
  Description of Artificial Sequence: Synthetic polypeptide
  Chain 2 (XenD25919) - human_IL12p35(N136D/N151D)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQDMLAVIDELMQALNFDSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 245 - protein, 438 aa, Artificial Sequence
  Description of Artificial Sequence: Synthetic polypeptide
  Chain 2 (XenD25920) - human_IL12p35(N21D/N151D)_(GGGGS)2_Fc (216)_IgG1_C220S/PVA_/S267K/S364K/E357Q
RNLPVATPDPGMFPCLHHSQDLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFDSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 246 - protein, 438 aa, Artificial Sequence
  Description of Artificial Sequence: Synthetic polypeptide
  Chain 2 (XenD25921) - human_IL12p35(E143Q/N151D)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDQLMQALNFDSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 247 - protein, 5 aa, Artificial Sequence
  Description of Artificial Sequence: Synthetic peptide
GGGGA

SEQ ID NO: 248 - protein, 10 aa, Artificial Sequence
  Description of Artificial Sequence: Synthetic peptide
GGGGAGGGGA

SEQ ID NO: 249 - protein, 15 aa, Artificial Sequence
  Description of Artificial Sequence: Synthetic peptide
GGGGAGGGGAGGGGA

SEQ ID NO: 250 - protein, 20 aa, Artificial Sequence
  Description of Artificial Sequence: Synthetic peptide
GGGGAGGGGAGGGGAGGGGA

SEQ ID NO: 251 - protein, 25 aa, Artificial Sequence
  Description of Artificial Sequence: Synthetic peptide
GGGGAGGGGAGGGGAGGGGAGGGGA

SEQ ID NO: 252 - protein, 30 aa, Artificial Sequence
  Description of Artificial Sequence: Synthetic polypeptide
GGGGAGGGGAGGGGAGGGGAGGGGAGGGGA

SEQ ID NO: 253 - protein, 35 aa, Artificial Sequence
  Description of Artificial Sequence: Synthetic polypeptide
GGGGAGGGGAGGGGAGGGGAGGGGAGGGGAGGGGA

SEQ ID NO: 254 - protein, 306 aa, Artificial Sequence
  Description of Artificial Sequence: Synthetic polypeptide
  IL-12p40(N103D/N113D)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKDKTFLRCEAKDYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 255 - protein, 306 aa, Artificial Sequence
  Description of Artificial Sequence: Synthetic polypeptide
  IL-12p40(N103D/N200D)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKDKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEDYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 256 - protein, 306 aa, Artificial Sequence
  Description of Artificial Sequence: Synthetic polypeptide
  IL-12p40(N103D/N281D)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKDKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKDASISVRAQDRYYSSSWSEWASVPCS

SEQ ID NO: 257 - protein, 306 aa, Artificial Sequence
  Description of Artificial Sequence: Synthetic polypeptide
  IL-12p40(N113D/N200D)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKDYSGRFTCWWLTTISTDLTFSVKSSRGSSDPQGVTCGAATLSAERVRGDNKEYEYSVECQEDSACPAAEESLPIEVMVDAVHKLKYEDYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 258 - protein, 306 aa, Artificial Sequence
  Description of Artificial Sequence: Synthetic polypeptide
  IL-12p40(N113D/N281D)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKDYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKDASISVRAQDRYYSSSWSEWASVPCS

SEQ ID NO: 259 - protein, 306 aa, Artificial Sequence
  Description of Artificial Sequence: Synthetic polypeptide
  IL-12p40(N200D/N281D)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEDYTSSFFIRDIIKPDPPKNLQLKPLKNSRQVEVSWEYPDTWSTPHSYFSLTFCVQVQGKSKREKKDRVFTDKTSATVICRKDASISVRAQDRYYSSSWSEWASVPCS

SEQ ID NO: 260 - protein, 306 aa, Artificial Sequence
  Description of Artificial Sequence: Synthetic polypeptide
  IL-12p40(N103D/N113D/N200D)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKDKTFLRCEAKDYSGRFTCWWLTTISTDLTFSVKSSRGSSDPQGVTCGAATLSAERVRGDNKEYEYSVECQEDSACPAAEESLPIEVMVDAVHKLKYEDYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 261 - protein, 306 aa, Artificial Sequence
  Description of Artificial Sequence: Synthetic polypeptide
  IL-12p40(N103D/N113D/N281D)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKDKTFLRCEAKDYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKDASISVRAQDRYYSSSWSEWASVPCS

SEQ ID NO: 262 - protein, 306 aa, Artificial Sequence
  Description of Artificial Sequence: Synthetic polypeptide
  IL-12p40(N103D/N200D/N281D)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKDKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEDYTSSFFIRDIIKPDPPKNLQLKPLKNSRQVEVSWEYPDTWSTPHSYFSLTFCVQVQGKSKREKKDRVFTDKTSATVICRKDASISVRAQDRYYSSSWSEWASVPCS

SEQ ID NO: 263 - protein, 306 aa, Artificial Sequence
  Description of Artificial Sequence: Synthetic polypeptide
  IL-12p40(N113D/N200D/N281D)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKDYSGRFTCWWLTTISTDLTFSVKSSRGSSDPQGVTCGAATLSAERVRGDNKEYEYSVECQEDSACPAAEESLPIEVMVDAVHKLKYEDYTSSFFIRDIIKPDPPKNLQLKPLKNSRQVEVSWEYPDTWSTPHSYFSLTFCVQVQGKSKREKKDRVFTDKTSATVICRKDASISVRAQDRYYSSSWSEWASVPCS

SEQ ID NO: 264 - protein, 306 aa, Artificial Sequence
  Description of Artificial Sequence: Synthetic polypeptide
  IL-12p40(N103Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKQKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 265 - protein, 306 aa, Artificial Sequence
  Description of Artificial Sequence: Synthetic polypeptide
  IL-12p40(N113Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKQYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 266 - protein, 306 aa, Artificial Sequence
  Description of Artificial Sequence: Synthetic polypeptide
  IL-12p40(N200Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 267 - protein, 306 aa, Artificial Sequence
  Description of Artificial Sequence: Synthetic polypeptide
  IL-12p40(N281Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKQASISVRAQDRYYSSSWSEWASVPCS

SEQ ID NO: 268 - protein, 306 aa, Artificial Sequence
  Description of Artificial Sequence: Synthetic polypeptide
  IL-12p40(N103Q/N113Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKQKTFLRCEAKQYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 269 - protein, 306 aa, Artificial Sequence
  Description of Artificial Sequence: Synthetic polypeptide
  IL-12p40(N103Q/N200Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKQKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 270 - protein, 306 aa, Artificial Sequence
  Description of Artificial Sequence: Synthetic polypeptide
  IL-12p40(N103Q/N281Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKQKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKQASISVRAQDRYYSSSWSEWASVPCS

SEQ ID NO: 271 - protein, 306 aa, Artificial Sequence
  Description of Artificial Sequence: Synthetic polypeptide
  IL-12p40(N113Q/N200Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKQYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 272 - protein, 306 aa, Artificial Sequence
  Description of Artificial Sequence: Synthetic polypeptide
  IL-12p40(N113Q/N281Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKQYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKQASISVRAQDRYYSSSWSEWASVPCS

SEQ ID NO: 273 - protein, 306 aa, Artificial Sequence
  Description of Artificial Sequence: Synthetic polypeptide
  IL-12p40(N200Q/N281Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKQASISVRAQDRYYSSSWSEWASVPCS

SEQ ID NO: 274 - protein, 306 aa, Artificial Sequence
  Description of Artificial Sequence: Synthetic polypeptide
  IL-12p40(N103Q/N113Q/N200Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKQKTFLRCEAKQYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 275 - protein, 306 aa, Artificial Sequence
  Description of Artificial Sequence: Synthetic polypeptide
  IL-12p40(N103Q/N113Q/N281Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKQKTFLRCEAKQYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKQASISVRAQDRYYSSSWSEWASVPCS

SEQ ID NO: 276 - protein, 306 aa, Artificial Sequence
  Description of Artificial Sequence: Synthetic polypeptide
  IL-12p40(N103Q/N200Q/N281Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKQKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKQASISVRAQDRYYSSSWSEWASVPCS

SEQ ID NO: 277 - protein, 306 aa, Artificial Sequence
  Description of Artificial Sequence: Synthetic polypeptide
  IL-12p40(N113Q/N200Q/N281Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKQYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKQASISVRAQDRYYSSSWSEWASVPCS

SEQ ID NO: 278 - protein, 306 aa, Artificial Sequence
  Description of Artificial Sequence: Synthetic polypeptide
  IL-12p40(N103Q/N113Q/N200Q/N281Q)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKQKTFLRCEAKQYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKQASISVRAQDRYYSSSWSEWASVPCS

SEQ ID NO: 279 - protein, 197 aa, Artificial Sequence
  Description of Artificial Sequence: Synthetic polypeptide
  IL-12p35(N71Q)
RNLPVATPDPGMFPCLHHSQNLLRAVSNMLQKARQTLEFYPCTSEEIDHEDITKDKTSTVEACLPLELTKQESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 280 - protein, 197 aa, Artificial Sequence
  Description of Artificial Sequence: Synthetic polypeptide
  IL-12p35(N85Q)
RNLPVATPDPGMFPCLHHSQNLLRAVSNMLQKARQTLEFYPCTSEEIDHEDITKDKTSTVEACLPLELTKNESCLNSRETSFITQGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 281 - protein, 197 aa, Artificial Sequence
  Description of Artificial Sequence: Synthetic polypeptide
  IL-12p35(N195Q)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLQAS

SEQ ID NO: 282 - protein, 197 aa, Artificial Sequence
  Description of Artificial Sequence: Synthetic polypeptide
  IL-12p35(N71Q/N85Q)
RNLPVATPDPGMFPCLHHSQNLLRAVSNMLQKARQTLEFYPCTSEEIDHEDITKDKTSTVEACLPLELTKQESCLNSRETSFITQGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 283 - protein, 197 aa, Artificial Sequence
  Description of Artificial Sequence: Synthetic polypeptide
  IL-12p35(N71Q/N195Q)
RNLPVATPDPGMFPCLHHSQNLLRAVSNMLQKARQTLEFYPCTSEEIDHEDITKDKTSTVEACLPLELTKQESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLQAS

SEQ ID NO: 284 - protein, 197 aa, Artificial Sequence
  Description of Artificial Sequence: Synthetic polypeptide
  IL-12p35(N85Q/N195Q)
RNLPVATPDPGMFPCLHHSQNLLRAVSNMLQKARQTLEFYPCTSEEIDHEDITKDKTSTVEACLPLELTKNESCLNSRETSFITQGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLQAS

SEQ ID NO: 285 - protein, 197 aa, Artificial Sequence
  Description of Artificial Sequence: Synthetic polypeptide
  IL-12p35(N71Q/N85Q/N195Q)
RNLPVATPDPGMFPCLHHSQNLLRAVSNMLQKARQTLEFYPCTSEEIDHEDITKDKTSTVEACLPLELTKQESCLNSRETSFITQGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLQAS

SEQ ID NO: 286 - protein, 197 aa, Artificial Sequence
  Description of Artificial Sequence: Synthetic polypeptide
  IL-12p35(N71D/N85D)
RNLPVATPDPGMFPCLHHSQNLLRAVSNMLQKARQTLEFYPCTSEEIDHEDITKDKTSTVEACLPLELTKDESCLNSRETSFITDGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 287 - protein, 197 aa, Artificial Sequence
  Description of Artificial Sequence: Synthetic polypeptide
  IL-12p35(N71D/N195D)
RNLPVATPDPGMFPCLHHSQNLLRAVSNMLQKARQTLEFYPCTSEEIDHEDITKDKTSTVEACLPLELTKDESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLDAS

SEQ ID NO: 288 - protein, 197 aa, Artificial Sequence
  Description of Artificial Sequence: Synthetic polypeptide
  IL-12p35(N85D/N195D)
RNLPVATPDPGMFPCLHHSQNLLRAVSNMLQKARQTLEFYPCTSEEIDHEDITKDKTSTVEACLPLELTKNESCLNSRETSFITDGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLDAS

SEQ ID NO: 289 - protein, 438 aa, Artificial Sequence
  Description of Artificial Sequence: Synthetic polypeptide
  XENP33008 Chain 2 - human_IL12p35(N71Q/N85Q)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKQESCLNSRETSFITQGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 290 - protein, 438 aa, Artificial Sequence
  Description of Artificial Sequence: Synthetic polypeptide
  XENP33009 Chain 2 - human_IL12p35(N71Q/N195Q)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKQESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLQASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 291 - protein, 547 aa, Artificial Sequence
  Description of Artificial Sequence: Synthetic polypeptide
  Chain 1 (XenD26411) - human_IL12p40_E59K/K99E_(GGGGS)2_Fc(216) _IgG1_pI(-)_Isosteric_A_C220S/PVA_/S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 292 - protein, 547 aa, Artificial Sequence
  Description of Artificial Sequence: Synthetic polypeptide
  XENP30598 Chain 1 (XenD26412) - human_IL12p40_D34N/E59K_(GGGGS)2 _Fc(216)_IgG1_pI(-)_Isosteric_A_C220S/PVA_/S267K/L368D/K370S
IWELKKDVYVVELDWYPDAPGEMVVLTCDTPEENGITWTLDQSSEVLGSGKTLTIQVKKFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 293 - protein, 547 aa, Artificial Sequence
  Description of Artificial Sequence: Synthetic polypeptide
  XENP30599 Chain 1 (XenD26413) - human_IL12p40_D34N/E59K/K99E_ (GGGGS)2_Fc(216)_IgG1_pI(-)_Isosteric_A_C220S/PVA_/S267K/ L368D/K370S
IWELKKDVYVVELDWYPDAPGEMVVLTCDTPEENGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 294 - protein, 547 aa, Artificial Sequence
  Description of Artificial Sequence: Synthetic polypeptide
  XENP30600 Chain 1 (XenD26414) - human_IL12p40_D34K/E59K/K99E_ (GGGGS)2_Fc(216)_IgG1_pI(-)_Isosteric_A_C220S/PVA_/S267K/ L368D/K370S
IWELKKDVYVVELDWYPDAPGEMVVLTCDTPEEKGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 295 - protein, 547 aa, Artificial Sequence
  Description of Artificial Sequence: Synthetic polypeptide
  Chain 1 (XenD26415) - human_IL12p40_E32Q/D34N/E59K/K99E_ (GGGGS)2_Fc(216)_IgG1_pI(-)_Isosteric_A_C220S/PVA_/S267K/ L368D/K370S
IWELKKDVYVVELDWYPDAPGEMVVLTCDTPQENGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 296 - protein, 547 aa, Artificial Sequence
  Description of Artificial Sequence: Synthetic polypeptide
  Chain 1 (XenD26416) - human_IL12p40_E32Q/D34K/E59K/K99E_ (GGGGS)2_Fc(216)_IgG1_pI(-)_Isosteric_A_C220S/PVA_/S267K/ L368D/K370S
IWELKKDVYVVELDWYPDAPGEMVVLTCDTPQEKGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 297 - protein, 547 aa, Artificial Sequence
  Description of Artificial Sequence: Synthetic polypeptide
  Chain 1 (XenD26417) - human_IL12p40_E32K/D34N/E59K/K99E_ (GGGGS)2_Fc(216)_IgG1_pI(-)_Isosteric_A_C220S/PVA_/S267K/ L368D/K370S
IWELKKDVYVVELDWYPDAPGEMVVLTCDTPKENGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 298 - protein, 547 aa, Artificial Sequence
  Description of Artificial Sequence: Synthetic polypeptide
  Chain 1 (XenD26418) - human_IL12p40_E32K/D34K/E59K/K99E_ (GGGGS)2_Fc(216)_IgG1_pI(-)_Isosteric_A_C220S/PVA_/S267K /L368D/K370S
IWELKKDVYVVELDWYPDAPGEMVVLTCDTPKEKGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 299 - protein, 438 aa, Artificial Sequence
  Description of Artificial Sequence: Synthetic polypeptide
  Chain 2 (XenD26427) - human_IL12p35_D55Q_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKQKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 300 - protein, 438 aa, Artificial Sequence
  Description of Artificial Sequence: Synthetic polypeptide
  XENP30609 Chain 2 (XenD26428) - human_IL12p35_D55K_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKKKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 301 - protein, 547 aa, Artificial Sequence
  Description of Artificial Sequence: Synthetic polypeptide
  XENP31250 Chain 1 (XenD27070) - human_IL12p40(E59Y/K99E)_ (GGGGS)2_Fc(216)_IgG1_pI(-)_Isosteric_A_C220S/PVA_/S267K/ L368D/K370S
IWELKKDVYVVELDWYPDAPGEMVVLTCDTPEEDGITWTLDQSSEVLGSGKTLTIQVKYFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 302 - protein, 547 aa, Artificial Sequence
  Description of Artificial Sequence: Synthetic polypeptide
  XENP31251 Chain 1 (XenD27071) - human_IL12p40(E59K/K99Y)_ (GGGGS)2_Fc(216)_IgG1_pI(-)_Isosteric_A_C220S/PVA_/S267K /L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQYEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 303 - protein, 547 aa, Artificial Sequence
  Description of Artificial Sequence: Synthetic polypeptide
  XENP31252 Chain 1 (XenD27072) - human_IL12p40(E59Y/K99Y)_ (GGGGS)2_Fc(216)_IgG1_pI(-)_Isosteric_A_C220S/PVA_/S267K /L368D/K370S
IWELKKDVYVVELDWYPDAPGEMVVLTCDTPEEDGITWTLDQSSEVLGSGKTLTIQVKYFGDAGQYTCHKGGEVLSHSLLLLHKKEDGIWSTDILKDQYEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 304 - protein, 547 aa, Artificial Sequence
  Description of Artificial Sequence: Synthetic polypeptide
  XENP31253 Chain 1 (XenD27073) - human_IL12p40(E45K/E59K/K99E)_ (GGGGS)2_Fc(216)_IgG1_pI(-)_Isosteric_A_C220S/PVA_/S267K/ L368D/K370S
IWELKKDVYVVELDWYPDAPGEMVVLTCDTPEEDGITWTLDQSSKVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 305 - protein, 547 aa, Artificial Sequence
  Description of Artificial Sequence: Synthetic polypeptide
  XENP31254 Chain 1 (XenD27074) - human_IL12p40(D18K/E59K/K99E)_ (GGGGS)2_Fc(216)_IgG1_pI(-)_Isosteric_A_C220S/PVA_/S267K/ L368D/K370S
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 306 - protein, 547 aa, Artificial Sequence
  Description of Artificial Sequence: Synthetic polypeptide
  XENP31255 Chain 1 (XenD27075) - human_IL12p40(E59K/K99E/Q144E)_ (GGGGS)2_Fc(216)_IgG1_pI(-)_Isosteric_A_C220S/PVA_/S267K/ L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPEGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 307 - protein, 547 aa, Artificial Sequence
  Description of Artificial Sequence: Synthetic polypeptide
  XENP31256 Chain 1 (XenD27076) - human_IL12p40(E59K/K99E/Q144K)_ (GGGGS)2_Fc(216)_IgG1_pI(-)_Isosteric_A_C220S/PVA_/S267K/L368D /K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPKGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 308 - protein, 547 aa, Artificial Sequence
  Description of Artificial Sequence: Synthetic polypeptide
  XENP31257 Chain 1 (XenD27077) - human_IL12p40(E59K/K99E/R159E)_ (GGGGS)2_Fc(216)_IgG1_pI(-)_Isosteric_A_C220S/PVA_/S267K/ L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVEGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 309 - protein, 547 aa, Artificial Sequence
  Description of Artificial Sequence: Synthetic polypeptide
  XENP31258 Chain 1 (XenD27078) - human_IL12p40(E59K/K99E/K264E)_ (GGGGS)2_Fc(216)_IgG1_pI(-)_Isosteric_A_C220S/PVA_/S267K/ L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKEDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 310 - protein, 438 aa, Artificial Sequence
  Description of Artificial Sequence: Synthetic polypeptide
  XENP31259 Chain 2 (XenD27088) - human_IL12p35(F96A)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITNGSCLASRKTSAMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 311 - protein, 438 aa, Artificial Sequence
  Description of Artificial Sequence: Synthetic polypeptide
  XENP31260 Chain 2 (XenD27089) - human_IL12p35(M97A)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITNGSCLASRKTSFAMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 312 - protein, 438 aa, Artificial Sequence
  Description of Artificial Sequence: Synthetic polypeptide
  XENP31261 Chain 2 (XenD27090) - human_IL12p35(L89A)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITNGSCAASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 313 - protein, 438 aa, Artificial Sequence
  Description of Artificial Sequence: Synthetic polypeptide
  XENP31262 Chain 2 (XenD27091) - human_IL12p35(L124A)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLAMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 314 - protein, 438 aa, Artificial Sequence
  Description of Artificial Sequence: Synthetic polypeptide
  XENP31263 Chain 2 (XenD27092) - human_IL12p35(M125A)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLADPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 315 - protein, 438 aa, Artificial Sequence
  Description of Artificial Sequence: Synthetic polypeptide
  XENP31264 Chain 2 (XenD27093) - human_IL12p35(L57A)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCANSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 316 - protein, 438 aa, Artificial Sequence
  Description of Artificial Sequence: Synthetic polypeptide
  XENP31265 Chain 2 (XenD27094) - human_IL12p35(I171A)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKAKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 317 - protein, 547 aa, Artificial Sequence
  Description of Artificial Sequence: Synthetic polypeptide
  XENP32186 Chain 1 (XenD28173) - human_IL12p40(D18K/E59K/K99E /K264E)_(GGGGS)2_Fc(216)_IgG1_pI(-)_Isosteric_A_C220S/PVA_ /S267K/L368D/K370S
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKEDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 318 - protein, 547 aa, Artificial Sequence
  Description of Artificial Sequence: Synthetic polypeptide
  XENP31142 Chain 1 (XenD24876) - human_IL12p40_(GGGGS)2_Fc (216)_IgG1_pI(-)_Isosteric_A_C220S/PVA_/S267K/L368D/K370S /M428L/N434S
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 319 - protein, 438 aa, Artificial Sequence
  Description of Artificial Sequence: Synthetic polypeptide
  Chain 2 (XenD24877) - human_IL12p35_(GGGGS)2_IgG1_PVA _/S267K/S364K/E357Q/M428L/N434S
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 320 - protein, 547 aa, Artificial Sequence
  Description of Artificial Sequence: Synthetic polypeptide
  XENP31143 Chain 1 (XenD27162) - human_IL12p40_E32Q/D34N/E59K/ K99E_(GGGGS)2_Fc(216)_IgG1_pI(-)_Isosteric_A_C220S/PVA_ /S267K/L368D/K370S/M428L/N434S
IWELKKDVYVVELDWYPDAPGEMVVLTCDTPQENGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 321 - protein, 547 aa, Artificial Sequence
  Description of Artificial Sequence: Synthetic polypeptide
  XENP31144 Chain 1 (XenD27163) - human_IL12p40_E32K/D34N/E59K/ K99E_(GGGGS)2_Fc(216)_IgG1_pI(-)_Isosteric_A_C220S/PVA_/ S267K/L368D/K370S/M428L/N434S
IWELKKDVYVVELDWYPDAPGEMVVLTCDTPKENGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 322 - protein, 438 aa, Artificial Sequence
  Description of Artificial Sequence: Synthetic polypeptide
  Chain 2 (XenD27166) - human_IL12p35_D55Q_(GGGGS)2_IgG1_PVA _/S267K/S364K/E357Q/M428L/N434S
RNLPVATPDPGMFPCLHHSQNLLRAVSNMLQKARQTLEFYPCTSEEIDHEDITKQKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 323 - protein, 547 aa, Artificial Sequence
  Description of Artificial Sequence: Synthetic polypeptide
  XENP31145 Chain 1 (XenD27164) - human_IL12p40_E32K/D34K/E59K /K99E_(GGGGS)2_Fc(216)_IgG1_pI(-)_Isosteric_A_C220S/ PVA_/S267K/L368D/K370S/M428L/N434S
IWELKKDVYVVELDWYPDAPGEMVVLTCDTPKEKGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 324 - protein, 547 aa, Artificial Sequence
  Description of Artificial Sequence: Synthetic polypeptide
  XENP31146 Chain 1 (XenD27165) - human_IL12p40_E59K/K99E_ (GGGGS)2_Fc(216)_IgG1_pI(-)_Isosteric_A_C220S/PVA _/S267K/L368D/K370S/M428L/N434S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 325 - protein, 306 aa, Artificial Sequence
  Description of Artificial Sequence: Synthetic polypeptide
  IL12p40(E59K/K99E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 326 - protein, 306 aa, Artificial Sequence
  Description of Artificial Sequence: Synthetic polypeptide
  IL12p40(D34N/E59K)
IWELKKDVYVVELDWYPDAPGEMVVLTCDTPEENGITWTLDQSSEVLGSGKTLTIQVKKFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 327 - protein, 306 aa, Artificial Sequence
  Description of Artificial Sequence: Synthetic polypeptide
  IL12p40(D34N/E59K/K99E)
IWELKKDVYVVELDWYPDAPGEMVVLTCDTPEENGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 328 - protein, 306 aa, Artificial Sequence
  Description of Artificial Sequence: Synthetic polypeptide
  IL12p40(D34K/E59K/K99E)
IWELKKDVYVVELDWYPDAPGEMVVLTCDTPEEKGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 329 - protein, 306 aa, Artificial Sequence
  Description of Artificial Sequence: Synthetic polypeptide
  IL12p40(E32Q/D34N/E59K/K99E)
IWELKKDVYVVELDWYPDAPGEMVVLTCDTPQENGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 330 - protein, 306 aa, Artificial Sequence
  Description of Artificial Sequence: Synthetic polypeptide
  IL12p40(E32Q/D34K/E59K/K99E)
IWELKKDVYVVELDWYPDAPGEMVVLTCDTPQEKGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 331 - protein, 306 aa, Artificial Sequence
  Description of Artificial Sequence: Synthetic polypeptide
  IL12p40(E32K/D34N/E59K/K99E)
IWELKKDVYVVELDWYPDAPGEMVVLTCDTPKENGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 332 - protein, 306 aa, Artificial Sequence
  Description of Artificial Sequence: Synthetic polypeptide
  IL12p40(E32K/D34K/E59K/K99E)
IWELKKDVYVVELDWYPDAPGEMVVLTCDTPKEKGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 333 - protein, 197 aa, Artificial Sequence
  Description of Artificial Sequence: Synthetic polypeptide
  IL12p35(D55Q)
RNLPVATPDPGMFPCLHHSQNLLRAVSNMLQKARQTLEFYPCTSEEIDHEDITKQKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 334 - protein, 197 aa, Artificial Sequence
  Description of Artificial Sequence: Synthetic polypeptide
  IL12p35(D55K)
RNLPVATPDPGMFPCLHHSQNLLRAVSNMLQKARQTLEFYPCTSEEIDHEDITKKKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 335 - protein, 306 aa, Artificial Sequence
  Description of Artificial Sequence: Synthetic polypeptide
  IL12p40(E59Y/K99E)
IWELKKDVYVVELDWYPDAPGEMVVLTCDTPEEDGITWTLDQSSEVLGSGKTLTIQVKYFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 336 - protein, 306 aa, Artificial Sequence
  Description of Artificial Sequence: Synthetic polypeptide
  IL12p40(E59K/K99Y)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQYEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 337 - protein, 306 aa, Artificial Sequence
  Description of Artificial Sequence: Synthetic polypeptide
  IL12p40(E59Y/K99Y)
IWELKKDVYVVELDWYPDAPGEMVVLTCDTPEEDGITWTLDQSSEVLGSGKTLTIQVKYFGDAGQYTCHKGGEVLSHSLLLLHKKEDGIWSTDILKDQYEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 338 - protein, 306 aa, Artificial Sequence
  Description of Artificial Sequence: Synthetic polypeptide
  IL12p40(E45K/E59K/K99E)
IWELKKDVYVVELDWYPDAPGEMVVLTCDTPEEDGITWTLDQSSKVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 339 - protein, 306 aa, Artificial Sequence
  Description of Artificial Sequence: Synthetic polypeptide
  IL12p40(D18K/E59K/K99E)
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 340 - protein, 306 aa, Artificial Sequence
  Description of Artificial Sequence: Synthetic polypeptide
  IL12p40(E59K/K99E/Q144E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPEGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 341 - protein, 306 aa, Artificial Sequence
  Description of Artificial Sequence: Synthetic polypeptide
  IL12p40(E59K/K99E/Q144K)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPKGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 342 - protein, 306 aa, Artificial Sequence
  Description of Artificial Sequence: Synthetic polypeptide
  IL12p40(E59K/K99E/R159E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVEGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 343 - protein, 306 aa, Artificial Sequence
  Description of Artificial Sequence: Synthetic polypeptide
  IL12p40(E59K/K99E/K264E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKEDRVFTDKTSATVICRKNASISVRAQDRYYSSSWSEWASVPCS

SEQ ID NO: 344 - protein, 306 aa, Artificial Sequence
  Description of Artificial Sequence: Synthetic polypeptide
  IL12p40(D18K/E59K/K99E/K264E)
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKEDRVFTDKTSATVICRKNASISVRAQDRYYSSSWSEWASVPCS

SEQ ID NO: 345 - protein, 197 aa, Artificial Sequence
  Description of Artificial Sequence: Synthetic polypeptide
  IL12p35(F96A)
RNLPVATPDPGMFPCLHHSQNLLRAVSNMLQKARQTLEFYPCTSEEIDHEDITKDKTSTVEACLPLELTKNESCLNSRETSFITNGSCLASRKTSAMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 346 - protein, 197 aa, Artificial Sequence
  Description of Artificial Sequence: Synthetic polypeptide
  IL12p35(M97A)
RNLPVATPDPGMFPCLHHSQNLLRAVSNMLQKARQTLEFYPCTSEEIDHEDITKDKTSTVEACLPLELTKNESCLNSRETSFITNGSCLASRKTSFAMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 347 - protein, 197 aa, Artificial Sequence
  Description of Artificial Sequence: Synthetic polypeptide
  IL12p35(L89A)
RNLPVATPDPGMFPCLHHSQNLLRAVSNMLQKARQTLEFYPCTSEEIDHEDITKDKTSTVEACLPLELTKNESCLNSRETSFITNGSCAASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 348 - protein, 197 aa, Artificial Sequence
  Description of Artificial Sequence: Synthetic polypeptide
  IL12p35(L124A)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLAMDPKRQIFLDQNMLAVIDELMQALNFNSETVPQKSSLEEPDFYKTKIKLCILLHAFRIRAVTIDRVMSYLNAS

SEQ ID NO: 349 - protein, 197 aa, Artificial Sequence
  Description of Artificial Sequence: Synthetic polypeptide
  IL12p35(M125A)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLADPKRQIFLDQNMLAVIDELMQALNFNSETVPQKSSLEEPDFYKTKIKLCILLHAFRIRAVTIDRVMSYLNAS

SEQ ID NO: 350 - protein, 197 aa, Artificial Sequence
  Description of Artificial Sequence: Synthetic polypeptide
  IL12p35(L75A)
RNLPVATPDPGMFPCLHHSQNLLRAVSNMLQKARQTLEFYPCTSEEIDHEDITKDKTSTVEACLPLELTKNESCANSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNAS

SEQ ID NO: 351 - protein, 197 aa, Artificial Sequence
  Description of Artificial Sequence: Synthetic polypeptide
  IL12p35(I171A)
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKAKLCILLHAFRIRAVTIDRVMSYLNAS

SEQ ID NO: 352 - protein, 438 aa, Artificial Sequence
  Description of Artificial Sequence: Synthetic polypeptide
  XENP33010 Chain 2 - human_IL12p35(N85Q/N195Q)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITQGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLQASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 353 - protein, 769 aa, Artificial Sequence
  Description of Artificial Sequence: Synthetic polypeptide
  XENP31291 human_IL12p40(E59K/K99E)_(GGGGS)5-human_IL12p35_ (GGGGS)2_Fc(216)_IgG1_pI(-)_Isosteric_A_C220S/PVA_/S267K /L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 354 - protein, 438 aa, Artificial Sequence
  Description of Artificial Sequence: Synthetic polypeptide
  XENP33011 Chain 2 - human_IL12p35(N71Q/N85Q/N195Q)_ (GGGGS)2_Fc(216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKQESCLNSRETSFITQGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLQASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 355 - protein, 442 aa, Artificial Sequence
  Description of Artificial Sequence: Synthetic polypeptide
  XENP016432 Nivolumab_H0L0_IgG1_PVA_/S267K Heavy Chain
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 356 - protein, 214 aa, Artificial Sequence
  Description of Artificial Sequence: Synthetic polypeptide
  XENP016432 Nivolumab_H0L0_IgG1_PVA_/S267K Light Chain
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 357 - protein, 547 aa, Artificial Sequence
  Description of Artificial Sequence: Synthetic polypeptide
  XENP31582 Chain 1 - human_IL12p40(D18K/E59K/K99E) _(GGGGS)2_Fc(216)_IgG1_pI(-)_Isosteric_A_C220S/PVA_ /S267K/L368D/K370S/M428L/N434S
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 358 - protein, 547 aa, Artificial Sequence
  Description of Artificial Sequence: Synthetic polypeptide
  XENP31583 Chain 1 - human_IL12p40(E59K/K99Y)_(GGGGS)2_Fc (216)_IgG1_pI(-)_Isosteric_A_C220S/PVA_/S267K/L368D/ K370S/M428L/N434S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQYEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 359 - protein, 547 aa, Artificial Sequence
  Description of Artificial Sequence: Synthetic polypeptide
  XENP31584 Chain 1 - human_IL12p40(E59K/K99E/K264E)_ (GGGGS)2_Fc(216)_IgG1_pI(-)_Isosteric_A_C220S/PVA_ /S267K/L368D/K370S/M428L/N434S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKEDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 360 - protein, 306 aa, Artificial Sequence
  Description of Artificial Sequence: Synthetic polypeptide
  IL-12p40(C252S)
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCS

SEQ ID NO: 361 - protein, 306 aa, Artificial Sequence
  Description of Artificial Sequence: Synthetic polypeptide
  IL-12p40(D18K/E59K/K99E/C252S)
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCS

SEQ ID NO: 362 - protein, 306 aa, Artificial Sequence
  Description of Artificial Sequence: Synthetic polypeptide
  IL-12p40(D18K/E59K/K99E/C252S/K264E)
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCS

SEQ ID NO: 363 - protein, 306 aa, Artificial Sequence
  Description of Artificial Sequence: Synthetic polypeptide
  IL-12p40(E59K/K99Y/C252S)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQYEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCS

SEQ ID NO: 364 - protein, 306 aa, Artificial Sequence
  Description of Artificial Sequence: Synthetic polypeptide
  IL-12p40(E59K/K99E/C252S/K264E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCS

SEQ ID NO: 365 - protein, 306 aa, Artificial Sequence
  Description of Artificial Sequence: Synthetic polypeptide
  IL-12p40(E59K/K99E/C252S)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCS

SEQ ID NO: 366 - protein, 306 aa, Artificial Sequence
  Description of Artificial Sequence: Synthetic polypeptide
  IL-12p40(E59K/K99E/N103Q/C252S/K264E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKQKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCS

SEQ ID NO: 367 - protein, 306 aa, Artificial Sequence
  Description of Artificial Sequence: Synthetic polypeptide
  IL-12p40(E59K/K99E/N113Q/C252S/K264E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKQYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCS

SEQ ID NO: 368 - protein, 306 aa, Artificial Sequence
  Description of Artificial Sequence: Synthetic polypeptide
  IL-12p40(E59K/K99E/N200Q/C252S/K264E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCS

SEQ ID NO: 369 - protein, 306 aa, Artificial Sequence
  Description of Artificial Sequence: Synthetic polypeptide
  IL-12p40(E59K/K99E/N281Q/C252S/K264E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKQASISVRAQDRYYSSSWSEWASVPCS

SEQ ID NO: 370 - protein, 306 aa, Artificial Sequence
  Description of Artificial Sequence: Synthetic polypeptide
  IL-12p40(E59K/K99E/N103Q/N113Q/C252S/K264E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKQKTFLRCEAKQYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCS

SEQ ID NO: 371 - protein, 306 aa, Artificial Sequence
  Description of Artificial Sequence: Synthetic polypeptide
  IL-12p40(E59K/K99E/N103Q/N200Q/C252S/K264E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKQKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCS

SEQ ID NO: 372 - protein, 306 aa, Artificial Sequence
  Description of Artificial Sequence: Synthetic polypeptide
  IL-12p40(E59K/K99E/N103Q/N281Q/C252S/K264E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKQKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKQASISVRAQDRYYSSSWSEWASVPCS

SEQ ID NO: 373 - protein, 306 aa, Artificial Sequence
  Description of Artificial Sequence: Synthetic polypeptide
  IL-12p40(E59K/K99E/N113Q/N200Q/C252S/K264E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKQYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCS

SEQ ID NO: 374 - protein, 306 aa, Artificial Sequence
  Description of Artificial Sequence: Synthetic polypeptide
  IL-12p40(IL12p40_E59K/K99E/N113Q/N281Q/C252S/K264E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKQYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKQASISVRAQDRYYSSSWSEWASVPCS

SEQ ID NO: 375 - protein, 306 aa, Artificial Sequence
  Description of Artificial Sequence: Synthetic polypeptide
  IL-12p40(E59K/K99E/N200Q/N281Q/C252S/K264E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKQASISVRAQDRYYSSSWSEWASVPCS

SEQ ID NO: 376 - protein, 306 aa, Artificial Sequence
  Description of Artificial Sequence: Synthetic polypeptide
  IL-12p40(E59K/K99E/N103Q/N113Q/N200Q/C252S/K264E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKQKTFLRCEAKQYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCS

SEQ ID NO: 377 - protein, 306 aa, Artificial Sequence
  Description of Artificial Sequence: Synthetic polypeptide
  IL-12p40(E59K/K99E/N103Q/N200Q/N281Q/C252S/K264E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKQKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKQASISVRAQDRYYSSSWSEWASVPCS

SEQ ID NO: 378 - protein, 306 aa, Artificial Sequence
  Description of Artificial Sequence: Synthetic polypeptide
  IL-12p40(E59K/K99E/N113Q/N200Q/N281Q/C252S/K264E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKQYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKQASISVRAQDRYYSSSWSEWASVPCS

SEQ ID NO: 379 - protein, 306 aa, Artificial Sequence
  Description of Artificial Sequence: Synthetic polypeptide
  IL-12p40(E59K/K99E/N103Q/N113Q/N200Q/N281Q/C252S/K264E)
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKQKTFLRCEAKQYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKQASISVRAQDRYYSSSWSEWASVPCS

SEQ ID NO: 380 - protein, 547 aa, Artificial Sequence
  Description of Artificial Sequence: Synthetic polypeptide
  XENP32187 Chain 1 - human_IL12p40(D18K/E59K/K99E/C252S)_ (GGGGS)2_Fc(216)_IgG1_pI(-)_Isosteric_A_C220S/PVA_/ S267K/L368D/K370S
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 381 - protein, 547 aa, Artificial Sequence
  Description of Artificial Sequence: Synthetic polypeptide
  XENP32188 Chain 1 - human_IL12p40(D18K/E59K/K99E/C252S/K264E) _(GGGGS)2_Fc(216)_IgG1_pI(-)_Isosteric_A_C220S/PVA_/S267K /L368D/K370S
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 382 - protein, 547 aa, Artificial Sequence
  Description of Artificial Sequence: Synthetic polypeptide
  XENP32189 Chain 1 - human_IL12p40(E59K/K99Y/C252S) _(GGGGS)2_Fc(216)_IgG1_pI(-)_Isosteric_A_C220S/PVA _/S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQYEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 383 - protein, 547 aa, Artificial Sequence
  Description of Artificial Sequence: Synthetic polypeptide
  XENP33011 Chain 1 - human_IL12p40(E59K/K99E/C252S/K264E) _(GGGGS)2_Fc(216)_IgG1_pI(-)_Isosteric_A_C220S/PVA_/ S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 384 - protein, 547 aa, Artificial Sequence
  Description of Artificial Sequence: Synthetic polypeptide
  XENP32191 Chain 1 - human_IL12p40(E59K/K99E/C252S) _(GGGGS)2_Fc(216)_IgG1_pI(-)_Isosteric_A_C220S/PVA _/S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 385 - protein, 547 aa, Artificial Sequence
  Description of Artificial Sequence: Synthetic polypeptide
  XENP32991 IL-12p40(E59K/K99E/N103Q/C252S/K264E_(GGGGS)2 _Fc(216)_IgG1_pI(-)_Isosteric_A_C220S/PVA_/S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKQKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 386 - protein, 547 aa, Artificial Sequence
  Description of Artificial Sequence: Synthetic polypeptide
  XENP32992 IL-12p40(E59K/K99E/N113Q/C252S/K264E_(GGGGS)2 _Fc(216)_IgG1_pI(-)_Isosteric_A_C220S/PVA_/S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKQYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 387 - protein, 547 aa, Artificial Sequence
  Description of Artificial Sequence: Synthetic polypeptide
  XENP32993 IL-12p40(E59K/K99E/N200Q/C252S/K264E_(GGGGS)2_Fc (216)_IgG1_pI(-)_Isosteric_A_C220S/PVA_/S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 388 - protein, 547 aa, Artificial Sequence
  Description of Artificial Sequence: Synthetic polypeptide
  XENP32994 IL-12p40(E59K/K99E/N281Q/C252S/K264E_(GGGGS)2_Fc (216)_IgG1_pI(-)_Isosteric_A_C220S/PVA_/S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKQASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 389 - protein, 547 aa, Artificial Sequence
  Description of Artificial Sequence: Synthetic polypeptide
  XENP32995 IL-12p40(E59K/K99E/N103Q/N113Q/C252S/K264E_ (GGGGS)2_Fc(216)_IgG1_pI(-)_Isosteric_A_C220S/PVA_/ S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKQKTFLRCEAKQYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 390 - protein, 547 aa, Artificial Sequence
  Description of Artificial Sequence: Synthetic polypeptide
  XENP32996 IL-12p40(E59K/K99E/N103Q/N200Q/C252S/K264E_ (GGGGS)2_Fc(216)_IgG1_pI(-)_Isosteric_A_C220S/PVA_/ S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKQKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 391 - protein, 547 aa, Artificial Sequence
  Description of Artificial Sequence: Synthetic polypeptide
  XENP32997 IL-12p40(E59K/K99E/N103Q/N281Q/C252S/K264E_ (GGGGS)2_Fc(216)_IgG1_pI(-)_Isosteric_A_C220S/PVA_/ S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKQKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKQASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 392 - protein, 547 aa, Artificial Sequence
  Description of Artificial Sequence: Synthetic polypeptide
  XENP32998 IL-12p40(E59K/K99E/N113Q/N200Q/C252S/K264E _(GGGGS)2_Fc(216)_IgG1_pI(-)_Isosteric_A_C220S/PVA_/ S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKQYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 393 - protein, 547 aa, Artificial Sequence
  Description of Artificial Sequence: Synthetic polypeptide
  XENP32999 IL-12p40(E59K/K99E/N113Q/N281Q/C252S/K264E_ (GGGGS)2_Fc(216)_IgG1_pI(-)_Isosteric_A_C220S/PVA_/ S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKQYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKQASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 394 - protein, 547 aa, Artificial Sequence
  Description of Artificial Sequence: Synthetic polypeptide
  XENP33000 IL-12p40(E59K/K99E/N200Q/N281Q/C252S/K264E_ (GGGGS)2_Fc(216)_IgG1_pI(-)_Isosteric_A_C220S/PVA_/ S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKQASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 395 - protein, 547 aa, Artificial Sequence
  Description of Artificial Sequence: Synthetic polypeptide
  XENP33001 IL-12p40(E59K/K99E/N103Q/N113Q/N200Q/C252S /K264E_(GGGGS)2_Fc(216)_IgG1_pI(-)_Isosteric_A_C220S /PVA_/S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKQKTFLRCEAKQYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 396 - protein, 547 aa, Artificial Sequence
  Description of Artificial Sequence: Synthetic polypeptide
  XENP33002 IL-12p40(E59K/K99E/N103Q/N200Q/N281Q/C252S/ K264E_(GGGGS)2_Fc(216)_IgG1_pI(-)_Isosteric_A_C220S/ PVA_/S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKQKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKQASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 397 - protein, 547 aa, Artificial Sequence
  Description of Artificial Sequence: Synthetic polypeptide
  XENP33003 IL-12p40(E59K/K99E/N113Q/N200Q/N281Q/C252S/ K264E_(GGGGS)2_Fc(216)_IgG1_pI(-)_Isosteric_A_C220S/ PVA_/S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKQYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKQASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 398 - protein, 547 aa, Artificial Sequence
  Description of Artificial Sequence: Synthetic polypeptide
  XENP33004 IL-12p40(E59K/K99E/N103Q/N113Q/N200Q/N281Q/C252S /K264E_(GGGGS)2_Fc(216)_IgG1_pI(-)_Isosteric_A_C220S/ PVA_/S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKQKTFLRCEAKQYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKQASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 399 - protein, 438 aa, Artificial Sequence
  Description of Artificial Sequence: Synthetic polypeptide
  XENP33005 Chain 2 - human_IL12p35(N71Q)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKQESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 400 - protein, 438 aa, Artificial Sequence
  Description of Artificial Sequence: Synthetic polypeptide
  XENP33006 Chain 2 - human_IL12p35(N85Q)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITQGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 401 - protein, 438 aa, Artificial Sequence
  Description of Artificial Sequence: Synthetic polypeptide
  XENP33007 Chain 2 - human_IL12p35(N195Q)_(GGGGS)2_Fc (216)_IgG1_C220S/PVA_/S267K/S364K/E357Q
RNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLQASGGGGSGGGGSEPKSSDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 402 - protein, 438 aa, Artificial Sequence; identical to SEQ ID NO: 48
  Description of Artificial Sequence: Synthetic polypeptide
  XENP32187 Chain 2 - IL12p35_(GGGGS)2_Fc(216)_IgG1 _C220S/PVA_/S267K/S364K/E357Q

SEQ ID NO: 403 - protein, 438 aa, Artificial Sequence; identical to SEQ ID NO: 48
  Description of Artificial Sequence: Synthetic polypeptide
  XENP32188 Chain 2 - IL12p35_(GGGGS)2_Fc(216)_IgG1 _C220S/PVA_/S267K/S364K/E357Q

SEQ ID NO: 404 - protein, 438 aa, Artificial Sequence; identical to SEQ ID NO: 48
  Description of Artificial Sequence: Synthetic polypeptide
  XENP32189 Chain 2 - IL12p35_(GGGGS)2_Fc(216)_IgG1 _C220S/PVA_/S267K/S364K/E357Q

SEQ ID NO: 405 - protein, 438 aa, Artificial Sequence; identical to SEQ ID NO: 48
  Description of Artificial Sequence: Synthetic polypeptide
  XENP32190 Chain 2 - IL12p35_(GGGGS)2_Fc(216)_IgG1 _C220S/PVA_/S267K/S364K/E357Q

SEQ ID NO: 406 - protein, 438 aa, Artificial Sequence; identical to SEQ ID NO: 48
  Description of Artificial Sequence: Synthetic polypeptide
  XENP32191 Chain 2 - IL12p35_(GGGGS)2_Fc(216)_IgG1 _C220S/PVA_/S267K/S364K/E357Q

SEQ ID NO: 407 - protein, 438 aa, Artificial Sequence; identical to SEQ ID NO: 48
  Description of Artificial Sequence: Synthetic polypeptide
  XENP32991 Chain 2 - human_IL12p35_(GGGGS)2_Fc(216)_IgG1 _C220S/PVA_/S267K/S364K/E357Q

SEQ ID NO: 408 - protein, 438 aa, Artificial Sequence; identical to SEQ ID NO: 48
  Description of Artificial Sequence: Synthetic polypeptide
  XENP32992 Chain 2 - human_IL12p35_(GGGGS)2_Fc(216)_IgG1 _C220S/PVA_/S267K/S364K/E357Q

SEQ ID NO: 409 - protein, 438 aa, Artificial Sequence; identical to SEQ ID NO: 48
  Description of Artificial Sequence: Synthetic polypeptide
  XENP32993 Chain 2 - human_IL12p35_(GGGGS)2_Fc(216)_IgG1 _C220S/PVA_/S267K/S364K/E357Q

SEQ ID NO: 410 - protein, 438 aa, Artificial Sequence; identical to SEQ ID NO: 48
  Description of Artificial Sequence: Synthetic polypeptide
  XENP32994 Chain 2 - human_IL12p35_(GGGGS)2_Fc(216)_IgG1 _C220S/PVA_/S267K/S364K/E357Q

SEQ ID NO: 411 - protein, 438 aa, Artificial Sequence; identical to SEQ ID NO: 48
  Description of Artificial Sequence: Synthetic polypeptide
  XENP32995 Chain 2 - human_IL12p35_(GGGGS)2_Fc(216)_IgG1 _C220S/PVA_/S267K/S364K/E357Q

SEQ ID NO: 412 - protein, 438 aa, Artificial Sequence; identical to SEQ ID NO: 48
  Description of Artificial Sequence: Synthetic polypeptide
  XENP32996 Chain 2 - human_IL12p35_(GGGGS)2_Fc(216)_IgG1 _C220S/PVA_/S267K/S364K/E357Q

SEQ ID NO: 413 - protein, 438 aa, Artificial Sequence; identical to SEQ ID NO: 48
  Description of Artificial Sequence: Synthetic polypeptide
  XENP32997 Chain 2 - human_IL12p35_(GGGGS)2_Fc(216)_IgG1 _C220S/PVA_/S267K/S364K/E357Q

SEQ ID NO: 414 - protein, 438 aa, Artificial Sequence; identical to SEQ ID NO: 48
  Description of Artificial Sequence: Synthetic polypeptide
  XENP32998 Chain 2 - human_IL12p35_(GGGGS)2_Fc(216)_IgG1 _C220S/PVA_/S267K/S364K/E357Q

SEQ ID NO: 415 - protein, 438 aa, Artificial Sequence; identical to SEQ ID NO: 48
  Description of Artificial Sequence: Synthetic polypeptide
  XENP32999 Chain 2 - human_IL12p35_(GGGGS)2_Fc(216)_IgG1 _C220S/PVA_/S267K/S364K/E357Q

SEQ ID NO: 416 - protein, 438 aa, Artificial Sequence; identical to SEQ ID NO: 48
  Description of Artificial Sequence: Synthetic polypeptide
  XENP33000 Chain 2 - human_IL12p35_(GGGGS)2_Fc(216)_IgG1 _C220S/PVA_/S267K/S364K/E357Q

SEQ ID NO: 417 - protein, 438 aa, Artificial Sequence; identical to SEQ ID NO: 48
  Description of Artificial Sequence: Synthetic polypeptide
  XENP33001 Chain 2 - human_IL12p35_(GGGGS)2_Fc(216)_IgG1 _C220S/PVA_/S267K/S364K/E357Q

SEQ ID NO: 418 - protein, 438 aa, Artificial Sequence; identical to SEQ ID NO: 48
  Description of Artificial Sequence: Synthetic polypeptide
  XENP33002 Chain 2 - human_IL12p35_(GGGGS)2_Fc(216)_IgG1 _C220S/PVA_/S267K/S364K/E357Q

SEQ ID NO: 419 - protein, 438 aa, Artificial Sequence; identical to SEQ ID NO: 48
  Description of Artificial Sequence: Synthetic polypeptide
  XENP33003 Chain 2 - human_IL12p35_(GGGGS)2_Fc(216)_IgG1 _C220S/PVA_/S267K/S364K/E357Q

SEQ ID NO: 420 - protein, 438 aa, Artificial Sequence; identical to SEQ ID NO: 48
  Description of Artificial Sequence: Synthetic polypeptide
  XENP33004 Chain 2 - human_IL12p35_(GGGGS)2_Fc(216)_IgG1 _C220S/PVA_/S267K/S364K/E357Q

SEQ ID NO: 421 - protein, 438 aa, Artificial Sequence; identical to SEQ ID NO: 319
  Description of Artificial Sequence: Synthetic polypeptide
  XENP31582 Chain 2 - human_IL12p35_(GGGGS)2_Fc(216)_IgG1 _C220S/PVA_/S267K/S364K/E357Q/M428L/N434S

SEQ ID NO: 422 - protein, 438 aa, Artificial Sequence; identical to SEQ ID NO: 319
  Description of Artificial Sequence: Synthetic polypeptide
  XENP31583 Chain 2 - human_IL12p35_(GGGGS)2_Fc(216)_IgG1 _C220S/PVA_/S267K/S364K/E357Q/M428L/N434S

SEQ ID NO: 423 - protein, 438 aa, Artificial Sequence; identical to SEQ ID NO: 319
  Description of Artificial Sequence: Synthetic polypeptide
  XENP31584 Chain 2 - human_IL12p35_(GGGGS)2_Fc(216)_IgG1 _C220S/PVA_/S267K/S364K/E357Q/M428L/N434S

SEQ ID NO: 424 - protein, 769 aa, Artificial Sequence; identical to SEQ ID NO: 353
  Description of Artificial Sequence: Synthetic polypeptide
  XENP31290 Chain 1 - human_IL12p40(E59K/K99E)_(GGGGS)5-human_ IL12p35_(GGGGS)2_(single-chain)_Fc(216)_IgG1_pI(-)_ Isosteric_A_C220S/PVA_/S267K/L368D/K370S

SEQ ID NO: 425 - protein, 547 aa, Artificial Sequence; identical to SEQ ID NO: 383
  Description of Artificial Sequence: Synthetic polypeptide
  XENP32190 Chain 1 - human_IL12p40(E59K/K99E/C252S/K264E)_ (GGGGS)2_Fc(216)_IgG1_pI(-)_Isosteric_A_C220S/PVA_/ S267K/L368D/K370S

SEQ ID NO: 426 - protein, 547 aa, Artificial Sequence; identical to SEQ ID NO: 383
  Description of Artificial Sequence: Synthetic polypeptide
  XENP33005 Chain 1 - human_IL12p40(E59K/K99E/C252S/K264E) _(GGGGS)2_Fc(216)_IgG1_pI(-)_Isosteric_A_C220S/PVA_/ S267K/L368D/K370S

SEQ ID NO: 427 - protein, 547 aa, Artificial Sequence; identical to SEQ ID NO: 383
  Description of Artificial Sequence: Synthetic polypeptide
  XENP33006 Chain 1 - human_IL12p40(E59K/K99E/C252S/K264E) _(GGGGS)2_Fc(216)_IgG1_pI(-)_Isosteric_A_C220S/PVA_/ S267K/L368D/K370S

SEQ ID NO: 428 - protein, 547 aa, Artificial Sequence; identical to SEQ ID NO: 383
  Description of Artificial Sequence: Synthetic polypeptide
  XENP33007 Chain 1 - human_IL12p40(E59K/K99E/C252S/K264E) _(GGGGS)2_Fc(216)_IgG1_pI(-)_Isosteric_A_C220S/PVA_/ S267K/L368D/K370S

SEQ ID NO: 429 - protein, 547 aa, Artificial Sequence; identical to SEQ ID NO: 383
  Description of Artificial Sequence: Synthetic polypeptide
  XENP33008 Chain 1 - human_IL12p40(E59K/K99E/C252S/K264E) _(GGGGS)2_Fc(216)_IgG1_pI(-)_Isosteric_A_C220S/PVA_/ S267K/L368D/K370S

SEQ ID NO: 430 - protein, 547 aa, Artificial Sequence; identical to SEQ ID NO: 383
  Description of Artificial Sequence: Synthetic polypeptide
  XENP33009 Chain 1 - human_IL12p40(E59K/K99E/C252S/K264E) _(GGGGS)2_Fc(216)_IgG1_pI(-)_Isosteric_A_C220S/PVA_/ S267K/L368D/K370S

SEQ ID NO: 431 - protein, 547 aa, Artificial Sequence; identical to SEQ ID NO: 383
  Description of Artificial Sequence: Synthetic polypeptide
  XENP33010 Chain 1 - human_IL12p40(E59K/K99E/C252S/K264E) _(GGGGS)2_Fc(216)_IgG1_pI(-)_Isosteric_A_C220S/PVA_/ S267K/L368D/K370S

SEQ ID NO: 432 - protein, 18 aa, Artificial Sequence
  Description of Artificial Sequence: Synthetic peptide
GSTSGSGKPGSGEGSTKG

SEQ ID NO: 433 - protein, 438 aa, Artificial Sequence; identical to SEQ ID NO: 48
  Description of Artificial Sequence: Synthetic polypeptide
  XENP29952 Chain 2 (XenD22915) - human_IL12p35_(GGGGS)2_Fc(216) _IgG1_C220S/PVA_/S267K/S364K/E357Q

SEQ ID NO: 434 - protein, 438 aa, Artificial Sequence; identical to SEQ ID NO: 48
  Description of Artificial Sequence: Synthetic polypeptide
  XENP29953 Chain 2 (XenD22915) - human_IL12p35_(GGGGS)2_Fc(216) _IgG1_C220S/PVA_/S267K/S364K/E357Q

SEQ ID NO: 435 - protein, 438 aa, Artificial Sequence; identical to SEQ ID NO: 48
  Description of Artificial Sequence: Synthetic polypeptide
  XENP29954 Chain 2 (XenD22915) - human_IL12p35_(GGGGS)2_Fc(216) _IgG1_C220S/PVA_/S267K/S364K/E357Q

SEQ ID NO: 436 - protein, 438 aa, Artificial Sequence; identical to SEQ ID NO: 48
  Description of Artificial Sequence: Synthetic polypeptide
  XENP29955 Chain 2 (XenD22915) - human_IL12p35_(GGGGS)2_Fc(216) _IgG1_C220S/PVA_/S267K/S364K/E357Q

SEQ ID NO: 437 - protein, 438 aa, Artificial Sequence; identical to SEQ ID NO: 48
  Description of Artificial Sequence: Synthetic polypeptide
  XENP29956 Chain 2 (XenD22915) - human_IL12p35_(GGGGS)2_Fc(216) _IgG1_C220S/PVA_/S267K/S364K/E357Q

SEQ ID NO: 438 - protein, 438 aa, Artificial Sequence; identical to SEQ ID NO: 48
  Description of Artificial Sequence: Synthetic polypeptide
  XENP29957 Chain 2 (XenD22915) - human_IL12p35_(GGGGS)2_Fc(216) _IgG1_C220S/PVA_/S267K/S364K/E357Q

SEQ ID NO: 439 - protein, 438 aa, Artificial Sequence; identical to SEQ ID NO: 48
  Description of Artificial Sequence: Synthetic polypeptide
  XENP29958 Chain 2 (XenD22915) - human_IL12p35_(GGGGS)2_Fc(216) _IgG1_C220S/PVA_/S267K/S364K/E357Q

SEQ ID NO: 440 - protein, 438 aa, Artificial Sequence; identical to SEQ ID NO: 48
  Description of Artificial Sequence: Synthetic polypeptide
  XENP29959 Chain 2 (XenD22915) - human_IL12p35_(GGGGS)2_Fc(216) _IgG1_C220S/PVA_/S267K/S364K/E357Q

SEQ ID NO: 441 - protein, 438 aa, Artificial Sequence; identical to SEQ ID NO: 48
  Description of Artificial Sequence: Synthetic polypeptide
  XENP29960 Chain 2 (XenD22915) - human_IL12p35_(GGGGS)2_Fc(216) _IgG1_C220S/PVA_/S267K/S364K/E357Q

SEQ ID NO: 442 - protein, 438 aa, Artificial Sequence; identical to SEQ ID NO: 48
  Description of Artificial Sequence: Synthetic polypeptide
  XENP29961 Chain 2 (XenD22915) - human_IL12p35_(GGGGS)2_Fc(216) _IgG1_C220S/PVA_/S267K/S364K/E357Q

SEQ ID NO: 443 - protein, 438 aa, Artificial Sequence; identical to SEQ ID NO: 48
  Description of Artificial Sequence: Synthetic polypeptide
  XENP30597 Chain 2 (XenD22915) - human_IL12p35_(GGGGS)2_Fc(216) _IgG1_C220S/PVA_/S267K/S364K/E357Q

SEQ ID NO: 444 - protein, 438 aa, Artificial Sequence; identical to SEQ ID NO: 48
  Description of Artificial Sequence: Synthetic polypeptide
  XENP30598 Chain 2 (XenD22915) - human_IL12p35_(GGGGS)2_Fc(216) _IgG1_C220S/PVA_/S267K/S364K/E357Q

SEQ ID NO: 445 - protein, 438 aa, Artificial Sequence; identical to SEQ ID NO: 48
  Description of Artificial Sequence: Synthetic polypeptide
  XENP30599 Chain 2 (XenD22915) - human_IL12p35_(GGGGS)2_Fc(216) _IgG1_C220S/PVA_/S267K/S364K/E357Q

SEQ ID NO: 446 - protein, 438 aa, Artificial Sequence; identical to SEQ ID NO: 48
  Description of Artificial Sequence: Synthetic polypeptide
  XENP30600 Chain 2 (XenD22915) - human_IL12p35_(GGGGS)2_Fc(216) _IgG1_C220S/PVA_/S267K/S364K/E357Q

SEQ ID NO: 447 - protein, 438 aa, Artificial Sequence; identical to SEQ ID NO: 48
  Description of Artificial Sequence: Synthetic polypeptide
  XENP30601 Chain 2 (XenD22915) - human_IL12p35_(GGGGS)2_Fc(216) _IgG1_C220S/PVA_/S267K/S364K/E357Q

SEQ ID NO: 448 - protein, 438 aa, Artificial Sequence; identical to SEQ ID NO: 48
  Description of Artificial Sequence: Synthetic polypeptide
  XENP30602 Chain 2 (XenD22915) - human_IL12p35_(GGGGS)2_Fc(216) _IgG1_C220S/PVA_/S267K/S364K/E357Q

SEQ ID NO: 449 - protein, 438 aa, Artificial Sequence; identical to SEQ ID NO: 48
  Description of Artificial Sequence: Synthetic polypeptide
  XENP30603 Chain 2 (XenD22915) - human_IL12p35_(GGGGS)2_Fc(216) _IgG1_C220S/PVA_/S267K/S364K/E357Q

SEQ ID NO: 450 - protein, 438 aa, Artificial Sequence; identical to SEQ ID NO: 48
  Description of Artificial Sequence: Synthetic polypeptide
  XENP30604 Chain 2 (XenD22915) - human_IL12p35_(GGGGS)2_Fc(216) _IgG1_C220S/PVA_/S267K/S364K/E357Q

SEQ ID NO: 451 - protein, 438 aa, Artificial Sequence; identical to SEQ ID NO: 48
  Description of Artificial Sequence: Synthetic polypeptide
  XENP31250 Chain 2 (XenD22915) - human_IL12p35_(GGGGS)2_Fc(216) _IgG1_C220S/PVA_/S267K/S364K/E357Q

SEQ ID NO: 452 - protein, 438 aa, Artificial Sequence; identical to SEQ ID NO: 48
  Description of Artificial Sequence: Synthetic polypeptide
  XENP31251 Chain 2 (XenD22915) - human_IL12p35_(GGGGS)2_Fc(216) _IgG1_C220S/PVA_/S267K/S364K/E357Q

SEQ ID NO: 453 - protein, 438 aa, Artificial Sequence; identical to SEQ ID NO: 48
  Description of Artificial Sequence: Synthetic polypeptide
  XENP31252 Chain 2 (XenD22915) - human_IL12p35_(GGGGS)2_Fc(216) _IgG1_C220S/PVA_/S267K/S364K/E357Q

SEQ ID NO: 454 - protein, 438 aa, Artificial Sequence; identical to SEQ ID NO: 48
  Description of Artificial Sequence: Synthetic polypeptide
  XENP31253 Chain 2 (XenD22915) - human_IL12p35_(GGGGS)2_Fc(216) _IgG1_C220S/PVA_/S267K/S364K/E357Q

SEQ ID NO: 455 - protein, 438 aa, Artificial Sequence; identical to SEQ ID NO: 48
  Description of Artificial Sequence: Synthetic polypeptide
  XENP31254 Chain 2 (XenD22915) - human_IL12p35_(GGGGS)2_Fc(216) _IgG1_C220S/PVA_/S267K/S364K/E357Q

SEQ ID NO: 456 - protein, 438 aa, Artificial Sequence; identical to SEQ ID NO: 48
  Description of Artificial Sequence: Synthetic polypeptide
  XENP31255 Chain 2 (XenD22915) - human_IL12p35_(GGGGS)2_Fc(216) _IgG1_C220S/PVA_/S267K/S364K/E357Q

SEQ ID NO: 457 - protein, 14 aa, Artificial Sequence
  Description of Artificial Sequence: Synthetic peptide
IRPRAIGGSKPRVA

SEQ ID NO: 458 - protein, 438 aa, Artificial Sequence; identical to SEQ ID NO: 48
  Description of Artificial Sequence: Synthetic polypeptide
  XENP31256 Chain 2 (XenD22915) - human_IL12p35_(GGGGS)2_Fc(216) _IgG1_C220S/PVA_/S267K/S364K/E357Q

SEQ ID NO: 459 - protein, 438 aa, Artificial Sequence; identical to SEQ ID NO: 48
  Description of Artificial Sequence: Synthetic polypeptide
  XENP31257 Chain 2 (XenD22915) - human_IL12p35_(GGGGS)2_Fc(216) _IgG1_C220S/PVA_/S267K/S364K/E357Q

SEQ ID NO: 460 - protein, 438 aa, Artificial Sequence; identical to SEQ ID NO: 48
  Description of Artificial Sequence: Synthetic polypeptide
  XENP31258 Chain 2 (XenD22915) - human_IL12p35_(GGGGS)2_Fc(216) _IgG1_C220S/PVA_/S267K/S364K/E357Q

SEQ ID NO: 461 - protein, 438 aa, Artificial Sequence; identical to SEQ ID NO: 48
  Description of Artificial Sequence: Synthetic polypeptide
  XENP32186 Chain 2 (XenD22915) - human_IL12p35_(GGGGS)2_Fc(216) _IgG1_C220S/PVA_/S267K/S364K/E357Q

SEQ ID NO: 462 - protein, 15 aa, Artificial Sequence
  Description of Artificial Sequence: Synthetic peptide
GKGGSGKGGSGKGGS

SEQ ID NO: 463 - protein, 15 aa, Artificial Sequence
  Description of Artificial Sequence: Synthetic peptide
GGKGSGGKGSGGKGS

SEQ ID NO: 464 - protein, 15 aa, Artificial Sequence
  Description of Artificial Sequence: Synthetic peptide
GGGKSGGGKSGGGKS

SEQ ID NO: 465 - protein, 15 aa, Artificial Sequence
  Description of Artificial Sequence: Synthetic peptide
GKGKSGKGKSGKGKS

SEQ ID NO: 466 - protein, 15 aa, Artificial Sequence
  Description of Artificial Sequence: Synthetic peptide
GGGKSGGKGSGKGGS

SEQ ID NO: 467 - protein, 231 aa, Artificial Sequence; identical to SEQ ID NO: 21
  Description of Artificial Sequence: Synthetic polypeptide
  XENP31290 Chain 2 - empty-Fc(216)_IgG1_C220S/PVA_/S267K/S364K /E357Q

SEQ ID NO: 468 - protein, 288 aa, Homo sapiens
MQIPQAPWPVVWAVLQLGWRPGWFLDSPDRPWNPPTFSPALLVVTEGDNATFTCSFSNTSESFVLNWYRMSPSNQTDKLAAFPEDRSQPGQDCRFRVTQLPNGRDFHMSVVRARRNDSGTYLCGAISLAPKAQIKESLRAELRVTERRAEVPTAHPSPSPRPAGQFQTLVVGVVGGLLGSLVLLVWVLAVICSRAARGTIGARRTGQPLKEDPSAVPVFSVDYGELDFQWREKTPEPPVPCVPEQTEYATIVFPSGMGTSSPARRGSADGPRSAQPLRPEDGHCSWPL

SEQ ID NO: 469 - protein, 150 aa, Homo sapiens [sequence omitted]

SEQ ID NO: 470 - protein, 288 aa, Macaca fascicularis
MQIPQAPWPVVWAVLQLGWRPGWFLESPDRPWNAPTFSPALLLVTEGDNATFTCSFSNASESFVLNWYRMSPSNQTDKLAAFPEDRSQPGQDCRFRVTRLPNGRDFHMSVVRARRNDSGTYLCGAISLAPKAQIKESLRAELRVTERRAEVPTAHPSPSPRPAGQFQALVVGVVGGLLGSLVLLVWVLAVICSRAAQGTIEARRTGQPLKEDPSAVPVFSVDYGELDFQWREKTPEPPAPCVPEQTEYATIVFPSGLGTSSPARRGSADGPRSPRPLRPEDGHCSWPL

SEQ ID NO: 471 - protein, 150 aa, Macaca fascicularis
PGWFLESPDRPWNAPTFSPALLLVTEGDNATFTCSFSNASESFVLNWYRMSPSNQTDKLAAFPEDRSQPGQDCRFRVTRLPNGRDFHMSVVRARRNDSGTYLCGAISLAPKAQIKESLRAELRVTERRAEVPTAHPSPSPRPAGQFQALV

SEQ ID NO: 472 - protein, 290 aa, Homo sapiens
MRIFAVFIFMTYWHLLNAFTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNERTHLVILGAILLCLGVALTFIFRLRKGRMMDVKKCGIQDTNSKKQSDTHLEET

SEQ ID NO: 473 - protein, 220 aa, Homo sapiens
FTVTVPKDLYVVEYGSNMTIECKFPVEKQLDLAALIVYWEMEDKNIIQFVHGEEDLKVQHSSYRQRARLLKDQLSLGNAALQITDVKLQDAGVYRCMISYGGADYKRITVKVNAPYNKINQRILVVDPVTSEHELTCQAEGYPKAEVIWTSSDHQVLSGKTTTTNSKREEKLFNVTSTLRINTTTNEIFYCTFRRLDPEENHTAELVIPELPLAHPPNER

SEQ ID NO: 474 - protein, 290 aa, Macaca fascicularis
MRIFAVFIFTIYWHLLNAFTVTVPKDLYVVEYGSNMTIECKFPVEKQLDLTSLIVYWEMEDKNIIQFVHGEEDLKVQHSNYRQRAQLLKDQLSLGNAALRITDVKLQDAGVYRCMISYGGADYKRITVKVNAPYNKINQRILVVDPVTSEHELTCQAEGYPKAEVIWTSSDHQVLSGKTTTTNSKREEKLLNVTSTLRINTTANEIFYCIFRRLDPEENHTAELVIPELPLALPPNERTHLVILGAIFLLLGVALTFIFYLRKGRMMDMKKCGIRVTNSKKQRDTQLEET

SEQ ID NO: 475 - protein, 220 aa, Macaca fascicularis
FTVTVPKDLYVVEYGSNMTIECKFPVEKQLDLTSLIVYWEMEDKNIIQFVHGEEDLKVQHSNYRQRAQLLKDQLSLGNAALRITDVKLQDAGVYRCMISYGGADYKRITVKVNAPYNKINQRILVVDPVTSEHELTCQAEGYPKAEVIWTSSDHQVLSGKTTTTNSKREEKLLNVTSTLRINTTANEIFYCIFRRLDPEENHTAELVIPELPLALPPNER

SEQ ID NO: 476 - protein, 117 aa, Artificial Sequence
  Description of Artificial Sequence: Synthetic polypeptide
  1C11[PD-1]_H0L0 Variable Heavy Chain
QIQLVQSGPELKKPGETVKISCRASGYTFTHYGMNWVKQAPGKGLKWMGWINTYTGEPTYADDFKGRFAFSLETSASTAYLQINNLKNEDTATYFCARDYYGSSPYWGQGTTLTVSS

SEQ ID NO: 477 - protein, 112 aa, Artificial Sequence
  Description of Artificial Sequence: Synthetic polypeptide
  1C11[PD-1]_H0L0 Variable Light Chain
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPNTFGGGTKLEIK

SEQ ID NO: 478 - protein, 117 aa, Artificial Sequence
  Description of Artificial Sequence: Synthetic polypeptide
  1C11[PD-1]_H3L3 Variable Heavy Chain
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSS

SEQ ID NO: 479 - protein, 112 aa, Artificial Sequence
  Description of Artificial Sequence: Synthetic polypeptide
  1C11[PD-1]_H3L3 Variable Light Chain
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 480 - protein, 117 aa, Artificial Sequence
  Description of Artificial Sequence: Synthetic polypeptide
  1C11[PD-1]_H3.240_L3.148 Variable Heavy Chain
QVQLVQSGPELKKPGESVKVSCKASGYTFTHYGINWVRQPPGQGLEWMGWINTYTGEPYYAPGFQERFVFSIDTSQDTAYLQINSLKAEDTAVYYCARDYYGSSPYWGQGTLVTVSS

SEQ ID NO: 481 - protein, 112 aa, Artificial Sequence
  Description of Artificial Sequence: Synthetic polypeptide
  1C11[PD-1]_H3.240_L3.148 Variable Light Chain
DIVMTQSPDSLAVSLGERVTINCKASQSIVHSNGNTYLEWYQQKPGQAPKLLIYKVSNRFSGVPDRFSGSGSGTDFTLTISSVEAEDAATYYCFQGSHVPNTFGQGTKVEIK

SEQ ID NO: 482 - protein, 117 aa, Artificial Sequence
  Description of Artificial Sequence: Synthetic polypeptide
  1C11[PD-1]_H3.241_L3.148 Variable Heavy Chain
EVQLVQSGPELKKPGESVKVSCKASGYTFTHYGINWVRQPPGQGLEWMGWINTYTGEPYYAPGFQERFVFSIDTSQDTAYLQINSLKAEDTAVYYCARDYYGSSPYWGQGTLVTVSS

SEQ ID NO: 483 - protein, 112 aa, Artificial Sequence; identical to SEQ ID NO: 481
  Description of Artificial Sequence: Synthetic polypeptide
  1C11[PD-1]_H3.241_L3.148 Variable Light Chain

SEQ ID NO: 484 - protein, 117 aa, Artificial Sequence
  Description of Artificial Sequence: Synthetic polypeptide
  1C11[PD-1]_H3.234_L3.144 Variable Heavy Chain
EVQLVQSGSELKKPGESVKVSCKASGYTFTHYGINWVRQPPGQGLEWMGWINTYTGEPYYAPGFQERFVFSLDTSQDTAYLQINSLKAEDTAVYYCARDYYGSSPYWGQGTLVTVSS

SEQ ID NO: 485 - protein, 112 aa, Artificial Sequence
  Description of Artificial Sequence: Synthetic polypeptide
  1C11[PD-1]_H3.234_L3.144 Variable Light Chain
DIVMTQSPDSLAVSLGERVTINCKASQSIVHSNGNTYLEWYQQKPGQPPKLLIYKVSNRFSGVPDRFSGSGSGTDFTLTISSVEAEDAATYYCFQGSHVPNTFGQGTKVEIK

SEQ ID NO: 486 - protein, 117 aa, Artificial Sequence; identical to SEQ ID NO: 482
  Description of Artificial Sequence: Synthetic polypeptide
  1C11[PD-1]_H3.241_L3.92 Variable Heavy Chain

SEQ ID NO: 487 - protein, 112 aa, Artificial Sequence
  Description of Artificial Sequence: Synthetic polypeptide
  1C11[PD-1]_H3.241_L3.92 Variable Light Chain
DIVMTQSPDSLAVSLGERVTINCKASQSIVHSNGNTYLEWYQQKPGQPPKLLIYKVSNRFTGVPDRFSGSGSGTDFTLTISSLQAEDVAVYYCFQGSHVPNTFGGGTKVEIK

SEQ ID NO: 488 - protein, 117 aa, Artificial Sequence
  Description of Artificial Sequence: Synthetic polypeptide
  1C11[PD-1]_H3.303_L3.152 Variable Heavy Chain
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYFGSSPYWGQGTLVTVSS

SEQ ID NO: 489 - protein, 112 aa, Artificial Sequence
  Description of Artificial Sequence: Synthetic polypeptide
  1C11[PD-1]_H3.303_L3.152 Variable Light Chain
DVLMTQSPDSLAVSLGERATINCKSSQSIVFSNGNTYLEWYQQKPGQSPKLLIYKVSNRFSGVPDRFSGSGSGTDFTLTISSLQAEDVAVYYCFQGSHVPNTFGGGTKVEIK

SEQ ID NO: 490 - protein, 117 aa, Artificial Sequence
  Description of Artificial Sequence: Synthetic polypeptide
  1C11_H3.329_L3.220 Variable Heavy Chain
QIQLVQSGSELLKPGASVSVSCKASGYTFTHYGMNWVRQAPGQGLEWMGWINTHTGEPTYADGFTGRFVFSLDTSVSTAYLQISSLKAEDTAVYFCARDYFGSSPYWGQGTLVTVSS

SEQ ID NO: 491 - protein, 112 aa, Artificial Sequence
  Description of Artificial Sequence: Synthetic polypeptide
  1C11_H3.329_L3.220 Variable Light Chain
DILMTQSPDSLAVSLGERATINCKSSQSIVYSNGNNYLEWYQQKPGQSPKLLIYKVSNRFSGVPDRFSGSGSGTDFTLTISSLQAEDVAVYYCFQGSHVPNTFGGGTKVEIK

SEQ ID NO: 492 - protein, 117 aa, Artificial Sequence
  Description of Artificial Sequence: Synthetic polypeptide
  1C11_H3.328_L3.152 Variable Heavy Chain
QIQLVQSGSELKKPGASVSVSCKASGYTFTHYGMNWVRQAPGQGLEWMGWINTHTGEPTYADGFTGRFVFSLDTSVSTAYLQISSLKAEDTAVYFCARDYFGSSPYWGQGTLVTVSS

SEQ ID NO: 493 - protein, 112 aa, Artificial Sequence; identical to SEQ ID NO: 489
  Description of Artificial Sequence: Synthetic polypeptide
  1C11_H3.328_L3.152 Variable Light Chain

SEQ ID NO: 494 - protein, 120 aa, Artificial Sequence [sequence omitted]

SEQ ID NO: 495 - protein, 111 aa, Artificial Sequence [sequence omitted]

SEQ ID NO: 496 - protein, 113 aa, Artificial Sequence [sequence omitted]

SEQ ID NO: 497 - protein, 107 aa, Artificial Sequence [sequence omitted]

SEQ ID NO: 498 - protein, 117 aa, Artificial Sequence
  Description of Artificial Sequence: Synthetic polypeptide
  pidilizumab[PD-1] variable heavy Chain
QVQLVQSGSELKKPGASVKISCKASGYTFTNYGMNWVRQAPGQGLQWMGWINTDSGESTYAEEFKGRFVFSLDTSVNTAYLQITSLTAEDTGMYFCVRVGYDALDYWGQGTLVTVSS

SEQ ID NO: 499 - protein, 106 aa, Artificial Sequence
  Description of Artificial Sequence: Synthetic polypeptide
  pidilizumab[PD-1] variable light Chain
EIVLTQSPSSLSASVGDRVTITCSARSSVSYMHWFQQKPGKAPKLWIYRTSNLASGVPSRFSGSGSGTSYCLTINSLQPEDFATYYCQQRSSFPLTFGGGTKLEIK

SEQ ID NO: 500 - protein, 120 aa, Artificial Sequence [sequence omitted]

SEQ ID NO: 501 - protein, 111 aa, Artificial Sequence [sequence omitted]

SEQ ID NO: 502 - protein, 117 aa, Artificial Sequence
  Description of Artificial Sequence: Synthetic polypeptide
  BAP049 Clone E[PD-1] variable heavy Chain
EVQLVQSGAEVKKPGESLRISCKGSGYTFTTYWMHWVRQATGQGLEWMGNIYPGTGGSNFDEKFKNRVTITADKSTSTAYMELSSLRSEDTAVYYCTRWTTGTGAYWGQGTTVTVSS

SEQ ID NO: 503 - protein, 113 aa, Artificial Sequence
  Description of Artificial Sequence: Synthetic polypeptide
  BAP049 Clone E[PD-1] variable light Chain
EIVLTQSPATLSLSPGERATLSCKSSQSLLDSGNQKNFLTWYQQKPGQAPRLLIYWASTRESGVPSRFSGSGSGTDFTFTISSLEAEDAATYYCQNDYSYPYTFGQGTKVEIK

SEQ ID NO: 504 - protein, 117 aa, Artificial Sequence; identical to SEQ ID NO: 502
  Description of Artificial Sequence: Synthetic polypeptide
  BAP049 Clone B[PD-1] variable heavy Chain

SEQ ID NO: 505 - protein, 78 aa, Artificial Sequence
  Description of Artificial Sequence: Synthetic polypeptide
  BAP049 Clone B[PD-1] variable light Chain
EIVLTQSPATLSLSPGERATLSCKSSQSLLDSGNQKNFLTWYQQKPGKAPKLLIYWASTRESGVPSRFSGSGSGTDFL

SEQ ID NO: 506 - protein, 117 aa, Artificial Sequence [sequence omitted]

SEQ ID NO: 507 - protein, 107 aa, Artificial Sequence [sequence omitted]

SEQ ID NO: 508 - protein, 122 aa, Artificial Sequence
  Description of Artificial Sequence: Synthetic polypeptide
  h1H3 Var 6[PD-1] variable heavy Chain
EVQLVESGGGLVQPGGSLRLSCAASGFTFSDYGMHWVRQAPGKGLEWVAYISSGSYTIYYADSVKGRFTISRDNAKNTLYLQMSSLRAEDTAVYYCARRGYGSFYEYYFDYWGQGTTVTVSS

SEQ ID NO: 509 - protein, 106 aa, Artificial Sequence
  Description of Artificial Sequence: Synthetic polypeptide
  h1H3 Var 6[PD-1] variable light Chain
QIVLTQSPATLSLSPGERATLSCSASSSVSYMYWYQQKPGQAPRLLIYLTSNRATGIPARFSGSGSGTDYTLTISSLEPEDFAVYYCQQWSSNPFTFGQGTKLEIK

SEQ ID NO: 510 - protein, 116 aa, Artificial Sequence
  Description of Artificial Sequence: Synthetic polypeptide
  APE2058[PD-1] variable heavy Chain
EVQLLESGGGLVQPGGSLRLSCAASGFTFSSYDMSWVRQAPGKGLEWVSTISGGGSYTYYQDSVKGRFTISRDNSKNTLYLQMNSLRAEDTAVYYCASPYYAMDYWGQGTTVTVSS

SEQ ID NO: 511 - protein, 107 aa, Artificial Sequence
  Description of Artificial Sequence: Synthetic polypeptide
  APE2058[PD-1] variable light Chain
DIQLTQSPSFLSAYVGDRVTITCKASQDVGTAVAWYQQKPGKAPKLLIYWASTLHTGVPSRFSGSGSGTEFTLTISSLQPEDFATYYCQHYSSYPWTFGQGTKLEIK

SEQ ID NO: 512 - protein, 116 aa, Artificial Sequence
  Description of Artificial Sequence: Synthetic polypeptide
  H005-1[PD-1] variable heavy Chain
EVQLVESGGGLVQPGGSLRLSCAASGFTFSSYMMSWVRQAPGKGLEWVATISGGGANTYYPDSVKGRFTISRDNAKNSLYLQMNSLRAEDTAVYYCARQLYYFDYWGQGTTVTVSS

SEQ ID NO: 513 - protein, 107 aa, Artificial Sequence
  Description of Artificial Sequence: Synthetic polypeptide
  H005-1[PD-1] variable light Chain
DIQMTQSPSSLSASVGDRVTITCLASQTIGTWLTWYQQKPGKAPKLLIYTATSLADGVPSRFSGSGSGTDFTLTISSLQPEDFATYYCQQVYSIPWTFGGGTKVEIK

SEQ ID NO: 514 - protein, 118 aa, Artificial Sequence
  Description of Artificial Sequence: Synthetic polypeptide
  317-4B6[PD-1] variable heavy Chain
QVQLQESGPGLVKPSETLSLTCTVSGFSLTSYGVHWIRQPPGKGLEWIGVIYADGSTNYNPSLKSRVTISKDTSKNQVSLKLSSVTAADTAVYYCARAYGNYWYIDVWGQGTTVTVSS

SEQ ID NO: 515 - protein, 107 aa, Artificial Sequence
  Description of Artificial Sequence: Synthetic polypeptide
  317-4B6[PD-1] variable light Chain
DIVMTQSPDSLAVSLGERATINCKSSESVSNDVAWYQQKPGQPPKLLINYAFHRFTGVPDRFSGSGYGTDFTLTISSLQAEDVAVYYCHQAYSSPYTFGQGTKLEIK

SEQ ID NO: 516 - protein, 114 aa, Artificial Sequence
  Description of Artificial Sequence: Synthetic polypeptide
  326-4A3[PD-1] variable heavy Chain
QVQLVQSGSELKKPGASVKVSCKASGYTFTNYGMNWVRQAPGQGLKWMGWINNNNAEPTYAQDFRGRFVFSLDTSASTAYLQISSLKTEDTAVYYCARDVMDYWGQGTLVTVSS

SEQ ID NO: 517 - protein, 110 aa, Artificial Sequence
  Description of Artificial Sequence: Synthetic polypeptide
  326-4A3[PD-1] variable light Chain
DIVLTQSPASLAVSPGQRATITCRASESVDNYGYSFMHWYQQKPGQPPKLLIYRASNLESGVPARFSGSGSGTDFTLTINPVEAEDTANYYCQQSKEYPTFGGGTKVEIK

SEQ ID NO: 518 - protein, 119 aa, Artificial Sequence
  Description of Artificial Sequence: Synthetic polypeptide
  hPD-1 mAb 7 (1.2)[PD-1] variable heavy Chain
QVQLVQSGAEVKKPGASVKVSCKASGYSFTSYWMNWVRQAPGQGLEWIGVIHPSDSETWLDQKFKDRVTITVDKSTSTAYMELSSLRSEDTAVYYCAREHYGTSPFAYWGQGTLVTVSS

SEQ ID NO: 519 - protein, 111 aa, Artificial Sequence
  Description of Artificial Sequence: Synthetic polypeptide
  hPD-1 mAb 7 (1.2)[PD-1] variable light Chain
EIVLTQSPATLSLSPGERATLSCRASESVDNYGMSFMNWFQQKPGQPPKLLIHAASNQGSGVPSRFSGSGSGTDFTLTISSLEPEDFAVYFCQQSKEVPYTFGGGTKVEIK

SEQ ID NO: 520 - protein, 125 aa, Artificial Sequence [sequence omitted]

SEQ ID NO: 521 - protein, 112 aa, Artificial Sequence [sequence omitted]

SEQ ID NO: 522 - protein, 125 aa, Artificial Sequence
  Description of Artificial Sequence: Synthetic polypeptide
  Clone 39[PD-1] variable heavy Chain
QGQLVQSGAEVKKPGASVKVSCKASGYTFTDYEMHWVRQAPGQGLEWMGVIESETGGTAYNQKFKGRAKITADKSTSTAYMELSSLRSEDTAVYYCTREGITTVATTYYWYFDVWGQGTTVTVSS

SEQ ID NO: 523 - protein, 112 aa, Artificial Sequence [sequence omitted]

SEQ ID NO: 524 - protein, 125 aa, Artificial Sequence
  Description of Artificial Sequence: Synthetic polypeptide
  Clone 41[PD-1] variable heavy Chain
QGQLVQSGAEVKKPGASVKVSCKASGYTFTDYEMHWVRQAPGQGLEWMGVIESETGGTAYNQKFQGRVTLTADKSSSTAYMELSSLRSEDTAVYYCTREGITTVATTYYWYFDVWGQGTLVTVSS

SEQ ID NO: 525 - protein, 112 aa, Artificial Sequence [sequence omitted]

SEQ ID NO: 526 - protein, 125 aa, Artificial Sequence; identical to SEQ ID NO: 522
  Description of Artificial Sequence: Synthetic polypeptide
  Clone 48[PD-1] variable heavy Chain

SEQ ID NO: 527 - protein, 112 aa, Artificial Sequence
  Description of Artificial Sequence: Synthetic polypeptide
  Clone 48[PD-1] variable light Chain
DVVMTQSPLSLPVTLGQPASISCRSSQSIVHSNGNTYLEWYLQKPGQSPRLLIYKVSNRFSGVPDRFSGSGSGTDFTLKISRVEAEDVGVYYCFQGSHVPLTFGQGTKLEIK

SEQ ID NO: 528 - protein, 128 aa, Artificial Sequence
  Description of Artificial Sequence: Synthetic polypeptide
  PD1-17[PD-1] variable heavy Chain
QVQLQESGPGVVKPSGTLSLTCAISGGSIGSGGSIRSTRWWSWVRQSPGKGLEWIGEIYHSGSTNYNPSLKSRVTISLDKSRNHFSLRLNSVTAADTAVYYCARQDYGDSGDWYFDLWGKGTMVTVSS

SEQ ID NO: 529 - protein, 110 aa, Artificial Sequence
  Description of Artificial Sequence: Synthetic polypeptide
  PD1-17[PD-1] variable light Chain
NFMLTQPHSVSESPGKTVTISCTRSSGSIASNSVQWYQQRPGSSPTTVIYEDNQRPSGVPDRFSGSIDSSSNSASLTVSGLKTEDEADYYCQSSDSSAVVFGSGTKLTVL

SEQ ID NO: 530 - protein, 119 aa, Artificial Sequence
  Description of Artificial Sequence: Synthetic polypeptide
  PD1-28[PD-1] variable heavy Chain
EVQLVQSGAEVKKPGASVKVSCKASGYRFTSYGISWVRQAPGQGLEWMGWISAYNGNTNYAQKLQGRVTMTTDTSTNTAYMELRSLRSDDTAVYYCARDADYSSGSGYWGQGTLVTVSS

SEQ ID NO: 531 - protein, 108 aa, Artificial Sequence
  Description of Artificial Sequence: Synthetic polypeptide
  PD1-28[PD-1] variable light Chain
SYELTQPPSVSVSPGQTARITCSGDALPKQYAYWYQQKPGQAPVMVIYKDTERPSGIPERFSGSSSGTKVTLTISGVQAEDEADYYCQSADNSITYRVFGGGTKVTVL

SEQ ID NO: 532 - protein, 119 aa, Artificial Sequence
  Description of Artificial Sequence: Synthetic polypeptide
  PD1-33[PD-1] variable heavy Chain
QVQLVQSGAEVKKPGASVRVSCKASGYTLTSYYIHWVRQAPGQGLEWMGIINPRGATISYAQKFQGRVTMTRDTSTSTVYMELRNLKSEDTALYYCATAGIYGFDFDYWGRGTLVTVSS

SEQ ID NO: 533 - protein, 111 aa, Artificial Sequence
  Description of Artificial Sequence: Synthetic polypeptide
  PD1-33[PD-1] variable light Chain
QSALTQPASVSGSPGQSITISCTGTSNDVGGYNYVSWYQHHPGKAPKLIIYDVTNRPSGVSDRFSGSKSGNTASLTISGLLAEDEGDYYCSSYTIVTNFEVLFGGGTKLTV

SEQ ID NO: 534 - protein, 127 aa, Artificial Sequence
  Description of Artificial Sequence: Synthetic polypeptide
  PD1-35[PD-1] variable heavy Chain
QVQLQESGPGLVKPSQTLSLTCTVSGGSISSGAYYWSWIRQHPGKGLEWIGYIYYNGNTYYNPSLRSLVTISVDASKNQFSLKLSSVTAADTAVYYCARASDYVWGGYRYMDAFDIWGRGTLITVSS

SEQ ID NO: 535 - protein, 112 aa, Artificial Sequence
  Description of Artificial Sequence: Synthetic polypeptide
  PD1-35[PD-1] variable light Chain
QSVLTQPPSASGTPGQRVTISCSGSNSNIGSNSVNWYQQLPGTAPKLLIYGNNQRPSGVPDRFSGSKSGTSASLAISGLQSENEADYYCAAWDDSLNGPVFGRGTKVTVLGE

SEQ ID NO: 536 - protein, 127 aa, Artificial Sequence
  Description of Artificial Sequence: Synthetic polypeptide
  LOPD180[PD-1] variable heavy Chain
QVQLQESGPGLVKPSQTLSLTCTVSGGSISSGAYYWSWIRQHPGKGLEWIGYIYYNGNTYYNPSLRSRVTISVDTSKNQFSLKLSSVTAADTAVYYCVRASDYVWGGYHYFDAFDLWGRGTLVTVSS

SEQ ID NO: 537 - protein, 110 aa, Artificial Sequence
  Description of Artificial Sequence: Synthetic polypeptide
  LOPD180[PD-1] variable light Chain
QSVLTQPPSASGTPGQRVTISCSGSNSNIGSNSVNWYQQLPGTAPKLLIYGNNQRPSGVPDRFSGSKSGTSASLAISGLQSEDEADYYCAAWDDSLNGPVFGGGTKVTVL

SEQ ID NO: 538 - protein, 119 aa, Artificial Sequence
  Description of Artificial Sequence: Synthetic polypeptide
  Ab948[PD-1] variable heavy Chain
EVQLQESGPGLVKPSQTLSLTCTVTGYSITSDYAWNWIRQPPGKKLEWMGYINYSGSTSYNPSLKSRVTISRDTSKNQFSLKLSSVTAADTAVYYCARWIGSSAWYFDVWGQGTLVTVS

SEQ ID NO: 539 - protein, 112 aa, Artificial Sequence
  Description of Artificial Sequence: Synthetic polypeptide
  Ab948[PD-1] variable light Chain
DVLMTQTPLSLSVTPGQPASISCRSGQNIVHSNGNTYLEWYLQKPGQSPKLLIYKVSNRFFGVPDRISGSGSGTDFTLKISRVEAEDVGVYFCFQGSHVPFTFGQGTKLEIK

SEQ ID NO: 540 - protein, 121 aa, Artificial Sequence
  Description of Artificial Sequence: Synthetic polypeptide
  humanized EH-12.2H7[PD-1] variable heavy Chain
QVQLVQSGHEVKQPGASVKMSCKASGYSFTSSWIHWVRQAPGQGLEWIGYIYPSTGFTEYNQKFKDRATLTADKSTSTAYMELSSLRSEDTAVYYCARWRDSSGYHAMDYWGQGTLVTVSS

SEQ ID NO: 541 - protein, 111 aa, Artificial Sequence
  Description of Artificial Sequence: Synthetic polypeptide
  humanized EH-12.2H7[PD-1] variable light Chain
EIVLTQSPATLSLSPGQRLTISCRASQSVSTSGYSYMHWYQQKPDQSPKLLIKFGSNLESGIPARFSGSGSGTDFTLTISSLEPEDFATYYCQHSWEIPYTFGQGTKLEIK

SEQ ID NO: 542 - protein, 119 aa, Artificial Sequence
  Description of Artificial Sequence: Synthetic polypeptide
  RG1H10[PD-1] variable heavy Chain
QVQLVQSGSELKKPGASVKISCKASGYIFSDNGVNWVRQAPGQGLEWMGWINTKIGNPTYAQGFTGRFVFSLDTSISTTYLQISSLQAGDTAVYYCAREHDYYYGMDVWGQGTTVTVSS

SEQ ID NO: 543 - protein, 111 aa, Artificial Sequence
  Description of Artificial Sequence: Synthetic polypeptide
  RG1H10[PD-1] variable light Chain
QSALTQPPSASGSPGQSVTISCTGTSSDVGGYNYVSWYQHHPGKAPKLMIYEVSKRPSGVPDRFSGSKSAITASLTISGLLTEDEADYYCSAWDDSLNADVFGGGTKVTVL

SEQ ID NO: 544 - protein, 119 aa, Artificial Sequence
  Description of Artificial Sequence: Synthetic polypeptide
  RG1H10-H2A-22-1S[PD-1] variable heavy Chain
QVQLVQSGSELKKPGASVKISCKASGYIFSDNGVNWVRQAPGQGLEWMGWINTKDGNPTYAQGFTGRFVFSLDTSISTTYLQISSLQAGDTAVYYCAREHDYYYGMDVWGQGTTVTVSS

SEQ ID NO: 545 - protein, 111 aa, Artificial Sequence; identical to SEQ ID NO: 543
  Description of Artificial Sequence: Synthetic polypeptide
  RG1H10-H2A-22-1S[PD-1] variable light Chain

SEQ ID NO: 546 - protein, 119 aa, Artificial Sequence
  Description of Artificial Sequence: Synthetic polypeptide
  RG1H10-H2A-27-2S[PD-1] variable heavy Chain
QVQLVQSGSELKKPGASVKISCKASGYIFSDNGVNWVRQAPGQGLEWMGWINTKTGNPTYAQGFTGRFVFSLDTSISTTYLQISSLQAGDTAVYYCAREHDYYYGMDVWGQGTTVTVSS

SEQ ID NO: 547 - protein, 111 aa, Artificial Sequence; identical to SEQ ID NO: 543
  Description of Artificial Sequence: Synthetic polypeptide
  RG1H10-H2A-27-2S[PD-1] variable light Chain

SEQ ID NO: 548 - protein, 119 aa, Artificial Sequence
  Description of Artificial Sequence: Synthetic polypeptide
  RG1H10-3C[PD-1] variable heavy Chain
QVQLVQSGSELKKPGASVKISCKASGYTFSDNGVNWVRQAPGQGLEWMGWINTKDGNPTYAQGFTGRFVFSLDTSISTTYLQISSLQAGDTAVYYCAREHDYYYGMDVWGQGTTVTVSS

SEQ ID NO: 549 - protein, 111 aa, Artificial Sequence; identical to SEQ ID NO: 543
  Description of Artificial Sequence: Synthetic polypeptide
  RG1H10-3C[PD-1] variable light Chain

SEQ ID NO: 550 - protein, 118 aa, Artificial Sequence
  Description of Artificial Sequence: Synthetic polypeptide
  RG1H10-16C[PD-1] variable heavy Chain
QVQLVQSGSELKKPGASVKISCKASGYTFSDNGVNWVRQAPGQGLEWMGWINTKTGNPTYAQGFTGRFVFSLDTSISTTYLQISSLQAGDTAVYYCAREHDYYYGMDVWGQGTTVTVS

SEQ ID NO: 551 - protein, 111 aa, Artificial Sequence; identical to SEQ ID NO: 543
  Description of Artificial Sequence: Synthetic polypeptide
  RG1H10-16C[PD-1] variable light Chain

SEQ ID NO: 552 - protein, 119 aa, Artificial Sequence
  Description of Artificial Sequence: Synthetic polypeptide
  RG1H10-17C[PD-1] variable heavy Chain
QVQLVQSGSELKKPGASVKISCKASGYKFSDNGVNWVRQAPGQGLEWMGWINTKSGNPTYAQGFTGRFVFSLDTSISTTYLQISSLQAGDTAVYYCAREHDYYYGMDVWGQGTTVTVSS

SEQ ID NO: 553 - protein, 111 aa, Artificial Sequence; identical to SEQ ID NO: 543
  Description of Artificial Sequence: Synthetic polypeptide
  RG1H10-17C[PD-1] variable light Chain

SEQ ID NO: 554 - protein, 119 aa, Artificial Sequence
  Description of Artificial Sequence: Synthetic polypeptide
  RG1H10-19C[PD-1] variable heavy Chain
QVQLVQSGSELKKPGASVKISCKASGYKFSDNGVNWVRQAPGQGLEWMGWINTKTGNPTYAQGFTGRFVFSLDTSISTTYLQISSLQAGDTAVYYCAREHDYYYGMDVWGQGTTVTVSS

SEQ ID NO: 555 - protein, 111 aa, Artificial Sequence; identical to SEQ ID NO: 543
  Description of Artificial Sequence: Synthetic polypeptide
  RG1H10-19C[PD-1] variable light Chain

SEQ ID NO: 556 - protein, 119 aa, Artificial Sequence
  Description of Artificial Sequence: Synthetic polypeptide
  RG1H10-21C[PD-1] variable heavy Chain
QVQLVQSGSELKKPGASVKISCKASGYTFSDNGVNWVRQAPGQGLEWMGWINTKSGNPTYAQGFTGRFVFSLDTSISTTYLQISSLQAGDTAVYYCAREHDYYYGMDVWGQGTTVTVSS

SEQ ID NO: 557 - protein, 111 aa, Artificial Sequence; identical to SEQ ID NO: 543
  Description of Artificial Sequence: Synthetic polypeptide
  RG1H10-21C[PD-1] variable light Chain

SEQ ID NO: 558 - protein, 119 aa, Artificial Sequence
  Description of Artificial Sequence: Synthetic polypeptide
  RG1H10-23C2[PD-1] variable heavy Chain
QVQLVQSGSELKKPGASVKISCKASGYKFSDNGVNWVRQAPGQGLEWMGWINTKDGNPTYAQGFTGRFVFSLDTSISTTYLQISSLQAGDTAVYYCAREHDYYYGMDVWGQGTTVTVSS

SEQ ID NO: 559 - protein, 111 aa, Artificial Sequence; identical to SEQ ID NO: 543
  Description of Artificial Sequence: Synthetic polypeptide
  RG1H10-23C2[PD-1] variable light Chain

SEQ ID NO: 560 - protein, 117 aa, Artificial Sequence
  Description of Artificial Sequence: Synthetic polypeptide
  mAb7[PD-1] variable heavy Chain
QVQLVQSGAEVKKPGASVKVSCKASGYTFTSYWINWVRQAPGQGLEWMGNIYPGSSLTNYNEKFKNRVTMTRDTSTSTVYMELSSLRSEDTAVYYCARLSTGTFAYWGQGTLVTVSS

SEQ ID NO: 561 - protein, 113 aa, Artificial Sequence
  Description of Artificial Sequence: Synthetic polypeptide
  mAb7[PD-1] variable light Chain
DIVMTQSPDSLAVSLGERATINCKSSQSLWDSGNQKNFLTWYQQKPGQPPKLLIYWTSYRESGVPDRFSGSGSGTDFTLTISSLQAEDVAVYYCQNDYFYPHTFGGGTKVEIK

SEQ ID NO: 562 - protein, 124 aa, Artificial Sequence
  Description of Artificial Sequence: Synthetic polypeptide
  PD1AB-6[PD-1] variable heavy Chain
EVQLVQSGAEVKKPGATVKISCKASGFNIKDTYMHWVQQAPGKGLEWMGRIDPANGDRKYDPKFQGRVTITADTSTDTAYMELSSLRSEDTAVYYCARSGPVYYYGSSYVMDYWGQGTTVTVSS

SEQ ID NO: 563 - protein, 112 aa, Artificial Sequence
  Description of Artificial Sequence: Synthetic polypeptide
  PD1AB-6[PD-1] variable light Chain
DIVMTQSPDSLAVSLGERATINCKSGQSVLYSSNQKNFLAWYQQKPGQPPKLLIYWASTRESGVPDRFSGSGSGTDFTLTISSLQAEDVAVYYCHQYLYSWTFGQGTKLEIK

SEQ ID NO: 564 - protein, 119 aa, Artificial Sequence
  Description of Artificial Sequence: Synthetic polypeptide
  mAb A[PD-1]_H1 Variable Heavy
QVQLQESGPGLVKPSQTLSLTCTVSGHSITSDYAWNWIRQPPGKKLEWIGYISYSGYTTYNPSLKSRVTISRDTSKNQFSLKLSSVTAADTAVYFCARDLDYGPWFAYWGQGTLVTVSS

SEQ ID NO: 565 - protein, 107 aa, Artificial Sequence
  Description of Artificial Sequence: Synthetic polypeptide
  mAb A[PD-1]_L1 Variable Light
DIQMTQSPSSLSASVGDRVTITCRASENIHNYLAWYQQKPGKSPKLLVYNVKTLADGVPSRFSGSGSGTDYTLTISSLQPEDFATYYCQHFWSSPWTFGGGTKVEIK

SEQ ID NO: 566 - protein, 117 aa, Artificial Sequence
  Description of Artificial Sequence: Synthetic polypeptide
  mAb B[PD-1]_H1 Variable Heavy
QVQLVQSGAEVKKPGASVKVSCKASGYTFTNFYIHWVRQAPGQSIEWMGSIYPNYGDTAYNQKFQGRVTMTVDKSISTAYMELSRLRSDDTAVYYCARGYSYAMDYWGQGTTVTVSS

SEQ ID NO: 567 - protein, 107 aa, Artificial Sequence
  Description of Artificial Sequence: Synthetic polypeptide
  mAb B[PD-1]_L1 Variable Light
DIQMTQSPSSLSASVGDRVTITCRASQGISGDLNWYQQKPGKTVKLLIYHTSSLHSGVPLRFSGSGSGTDYTLTISSLQPEDFATYYCQYYSKDLLTFGAGTKLEIK

SEQ ID NO: 568 - protein, 119 aa, Artificial Sequence
  Description of Artificial Sequence: Synthetic polypeptide
  mAb C[PD-1]_H1 Variable Heavy
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 569 - protein, 119 aa, Artificial Sequence
  Description of Artificial Sequence: Synthetic polypeptide
  mAb C[PD-1]_H1.19 Variable Heavy
EVQLVESGGGLVQPGGSLRLSCAASGFTFSSLGMHWVRQAPGKGLEWVSYISSGSSIIYYADSVKGRFTISRDNAKNSLYLQMNSLRAEDTAVYYCARGGRLVWSPDYWGQGTLVTVSS

SEQ ID NO: 570 - protein, 119 aa, Artificial Sequence
  Description of Artificial Sequence: Synthetic polypeptide
  mAb C[PD-1]_H1.48 Variable Heavy
EVQLVESGGGLVQPGGSLRLSCAASGFTFSSFGMHWVRQAPGKGLEWVSYISGGSSIIYYADSVKGRFTISRDNAKNSLYLQMNSLRAEDTAVYYCARGGRLVWSPDYWGQGTLVTVSS

SEQ ID NO: 571 - protein, 119 aa, Artificial Sequence
  Description of Artificial Sequence: Synthetic polypeptide
  mAb C[PD-1]_H1.125 Variable Heavy
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGELVWSPDYWGQGTLVTVSS

SEQ ID NO: 572 - protein, 119 aa, Artificial Sequence
  Description of Artificial Sequence: Synthetic polypeptide
  mAb C[PD-1]_H1.130 Variable Heavy
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGYLVWSPDYWGQGTLVTVSS

SEQ ID NO: 573 - protein, 119 aa, Artificial Sequence
  Description of Artificial Sequence: Synthetic polypeptide
  mAb C[PD-1]_H1.132 Variable Heavy
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGWLVWSPDYWGQGTLVTVSS

SEQ ID NO: 574 - protein, 119 aa, Artificial Sequence
  Description of Artificial Sequence: Synthetic polypeptide
  mAb C[PD-1]_H1.169 Variable Heavy
EVQLVESGGGLVQPGGSLRLSCAASGFTFSSLGMHWVRQAPGKGLEWVSYISGGSSIIYYADSVKGRFTISRDNAKNSLYLQMNSLRAEDTAVYYCARGGRLVWSPDYWGQGTLVTVSS

SEQ ID NO: 575 - protein, 119 aa, Artificial Sequence
  Description of Artificial Sequence: Synthetic polypeptide
  mAb C[PD-1]_H1.175 Variable Heavy
EVQLVESGGGLVQPGGSLRLSCAASGFTFSSLGMHWVRQAPGKGLEWVSYISGGSSIIYYADSVKGRFTISRDNAKNSLYLQMNSLRAEDTAVYYCARGGWLVWSPDYWGQGTLVTVSS

SEQ ID NO: 576 - protein, 119 aa, Artificial Sequence
  Description of Artificial Sequence: Synthetic polypeptide
  mAb C[PD-1]_H2 Variable Heavy
EVQLVESGGGLVKPGGSLRLSCAASGFTFSSFGMHWVRQAPGKGLEWVGYISSGSSIIYYADPVKGRFTISRDNSKNTLYLQMNSLKTEDTAVYYCARGGRLVWSPDYWGQGTLVTVSS

SEQ ID NO: 577 - protein, 113 aa, Artificial Sequence
  Description of Artificial Sequence: Synthetic polypeptide
  mAb C[PD-1]_L1 Variable Light
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYSYPFTFGSGTKLEIK

SEQ ID NO: 578 - protein, 113 aa, Artificial Sequence
  Description of Artificial Sequence: Synthetic polypeptide
  mAb C[PD-1]_L1.1 Variable Light
DIVMTQSPDSLAVSLGERATINCKSSQSLLHSGNQKNYLTWYQQKPGQPPKLLIYWASTRESGVPDRFTGSGSGTDFTLTISSLQAEDVAVYYCQNDYSYPFTFGSGTKLEIK

SEQ ID NO: 579 - protein, 113 aa, Artificial Sequence
  Description of Artificial Sequence: Synthetic polypeptide
  mAb C[PD-1]_L1.3 Variable Light
DIVMTQSPDSLAVSLGERATINCKSSQSLLSSGNQKNYLTWYQQKPGQPPKLLIYWASTRESGVPDRFTGSGSGTDFTLTISSLQAEDVAVYYCQNDYSYPFTFGSGTKLEIK

SEQ ID NO: 580 - protein, 113 aa, Artificial Sequence
  Description of Artificial Sequence: Synthetic polypeptide
  mAb C[PD-1]_L1.45 Variable Light
DIVMTQSPDSLAVSLGERATINCKSSQSLLNSGNQYNYLTWYQQKPGQPPKLLIYWASTRESGVPDRFTGSGSGTDFTLTISSLQAEDVAVYYCQNDYSYPFTFGSGTKLEIK

SEQ ID NO: 581 - protein, 113 aa, Artificial Sequence
  Description of Artificial Sequence: Synthetic polypeptide
  mAb C[PD-1]_L1.117 Variable Light
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYTYPFTFGSGTKLEIK

SEQ ID NO: 582 - protein, 113 aa, Artificial Sequence
  Description of Artificial Sequence: Synthetic polypeptide
  mAb C[PD-1]_L1.129 Variable Light
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYSWPFTFGSGTKLEIK

SEQ ID NO: 583 - protein, 113 aa, Artificial Sequence
  Description of Artificial Sequence: Synthetic polypeptide
  mAb C[PD-1]_L1.135 Variable Light
DIVMTQSPDSLAVSLGERATINCKSSQSLLHSGNQYNYLTWYQQKPGQPPKLLIYWASTRESGVPDRFTGSGSGTDFTLTISSLQAEDVAVYYCQNDYSYPFTFGSGTKLEIK

SEQ ID NO: 584 - protein, 113 aa, Artificial Sequence
  Description of Artificial Sequence: Synthetic polypeptide
  mAb C[PD-1]_L1.136 Variable Light
DIVMTQSPDSLAVSLGERATINCKSSQSLLHSGNQKNYLTWYQQKPGQPPKLLIYWASTRESGVPDRFTGSGSGTDFTLTISSLQAEDVAVYYCQNDYTYPFTFGSGTKLEIK

SEQ ID NO: 585 - protein, 113 aa, Artificial Sequence
  Description of Artificial Sequence: Synthetic polypeptide
  mAb C[PD-1]_L1.140 Variable Light
DIVMTQSPDSLAVSLGERATINCKSSQSLLHSGNQYNYLTWYQQKPGQPPKLLIYWASTRESGVPDRFTGSGSGTDFTLTISSLQAEDVAVYYCQNDYTYPFTFGSGTKLEIK

SEQ ID NO: 586 - protein, 113 aa, Artificial Sequence
  Description of Artificial Sequence: Synthetic polypeptide
  mAb C[PD-1]_L2 Variable Light
DIVMTQSPLSLPVTPGEPASISCRSSQSLLNSGNQKNYLTWYLQKPGQPPQLLIYWASTRESGVPDRFTGSGSGTDFTLKISRVEAEDVGVYYCQNDYSYPFTFGSGTKLEIK

SEQ ID NO: 587 - protein, 446 aa, Artificial Sequence
  Description of Artificial Sequence: Synthetic polypeptide
  XENP021575 1C11[PD-1]_H0L0_IgG1_PVA_/S267K Heavy Chain
QIQLVQSGPELKKPGETVKISCRASGYTFTHYGMNWVKQAPGKGLKWMGWINTYTGEPTYADDFKGRFAFSLETSASTAYLQINNLKNEDTATYFCARDYYGSSPYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 588 - protein, 219 aa, Artificial Sequence
  Description of Artificial Sequence: Synthetic polypeptide
  XENP021575 1C11[PD-1]_H0L0_IgG1_PVA_/S267K Light Chain
DVLMTQTPLSLPVSLGDQASISCRSSQSIVHSNGNTYLEWYLQKPGQSPKLLIYKVSNRFSGVPDRFSGSGSGTDFTLKISRVEAEDLGVYYCFQGSHVPNTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 589 - protein, 446 aa, Artificial Sequence
  Description of Artificial Sequence: Synthetic polypeptide
  XENP022553 1C11[PD-1]_H3L3_IgG1_PVA_/S267K Heavy Chain
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 590 - protein, 219 aa, Artificial Sequence
  Description of Artificial Sequence: Synthetic polypeptide
  XENP022553 1C11[PD-1]_H3L3_IgG1_PVA_/S267K Light Chain
DVLMTQSPDSLAVSLGERATINCKSSQSIVHSNGNTYLEWYQQKPGQSPKLLIYKVSNRFSGVPDRFSGSGSGTDFTLTISSLQAEDVAVYYCFQGSHVPNTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 591 - protein, 448 aa, Artificial Sequence
  Description of Artificial Sequence: Synthetic polypeptide
  XENP28519 Chain 1 - mAb A[PD-1]_H1_IgG1_PVA_/S267K Heavy Chain
QVQLQESGPGLVKPSQTLSLTCTVSGHSITSDYAWNWIRQPPGKKLEWIGYISYSGYTTYNPSLKSRVTISRDTSKNQFSLKLSSVTAADTAVYFCARDLDYGPWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 592 - protein, 214 aa, Artificial Sequence
  Description of Artificial Sequence: Synthetic polypeptide
  XENP28519 Chain 2 - mAb A[PD-1]_L1 Light Chain
DIQMTQSPSSLSASVGDRVTITCRASENIHNYLAWYQQKPGKSPKLLVYNVKTLADGVPSRFSGSGSGTDYTLTISSLQPEDFATYYCQHFWSSPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 593 - protein, 446 aa, Artificial Sequence
  Description of Artificial Sequence: Synthetic polypeptide
  XENP28686 Chain 1 - mAb B[PD-1]_H1_IgG1_PVA_/S267K Heavy Chain
QVQLVQSGAEVKKPGASVKVSCKASGYTFTNFYIHWVRQAPGQSIEWMGSIYPNYGDTAYNQKFQGRVTMTVDKSISTAYMELSRLRSDDTAVYYCARGYSYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 594 - protein, 214 aa, Artificial Sequence
  Description of Artificial Sequence: Synthetic polypeptide
  XENP28686 Chain 2 - mAb B[PD-1]_L1 Light Chain
DIQMTQSPSSLSASVGDRVTITCRASQGISGDLNWYQQKPGKTVKLLIYHTSSLHSGVPLRFSGSGSGTDYTLTISSLQPEDFATYYCQYYSKDLLTFGAGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 595 - protein, 448 aa, Artificial Sequence
  Description of Artificial Sequence: Synthetic polypeptide
  XENP28536 Chain 1 - mAb C[PD-1]_H1_IgG1_PVA_/S267K Heavy Chain
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLVWSPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 596 - protein, 220 aa, Artificial Sequence
  Description of Artificial Sequence: Synthetic polypeptide
  XENP28536 Chain 2 - mAb C[PD-1]_L1 Light Chain
DIVMTQSPDSLAVSLGERATINCKSSQSLLNSGNQKNYLTWYQQKPGQPPKLLIYWASTRESGVPDRFTGSGSGTDFTLTISSLQAEDVAVYYCQNDYSYPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 597 - protein, 121 aa, Artificial Sequence
  Description of Artificial Sequence: Synthetic polypeptide
  durvalumab[PD-L1] variable heavy Chain
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSS

SEQ ID NO: 598 - protein, 108 aa, Artificial Sequence
  Description of Artificial Sequence: Synthetic polypeptide
  durvalumab[PD-L1] variable light Chain
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTKVEIK

SEQ ID NO: 599 - protein, 118 aa, Artificial Sequence
  Description of Artificial Sequence: Synthetic polypeptide
  atezolizumab[PD-L1] variable heavy Chain
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSA

SEQ ID NO: 600 - protein, 108 aa, Artificial Sequence
  Description of Artificial Sequence: Synthetic polypeptide
  atezolizumab[PD-L1] variable light Chain
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKR

SEQ ID NO: 601 - protein, 120 aa, Artificial Sequence
  Description of Artificial Sequence: Synthetic polypeptide
  A09-246-2[PD-L1] variable heavy Chain
EVQLLESGGGLVQPGGSLRLSCAASGFTFSSYIMMWVRQAPGKGLEWVSSIYPSGGITFYADTVKGRFTISRDNSKNTLYLQMNSLRAEDTAVYYCARIKLGTVTTVDYWGQGTLVTVSS

SEQ ID NO: 602 - protein, 110 aa, Artificial Sequence
  Description of Artificial Sequence: Synthetic polypeptide
  A09-246-2[PD-L1] variable light Chain
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVL

SEQ ID NO: 603 - protein, 123 aa, Artificial Sequence
  Description of Artificial Sequence: Synthetic polypeptide
  12A4[PD-L1] variable heavy Chain
QVQLVQSGAEVKKPGSSVKVSCKTSGDTFSTYAISWVRQAPGQGLEWMGGIIPIFGKAHYAQKFQGRVTITADESTSTAYMELSSLRSEDTAVYFCARKFHFVSGSPFGMDVWGQGTTVTVSS

SEQ ID NO: 604 - protein, 106 aa, Artificial Sequence
  Description of Artificial Sequence: Synthetic polypeptide
  12A4[PD-L1] variable light Chain
EIVLTQSPATLSLSPGERATLSCRASQSVSSYLAWYQQKPGQAPRLLIYDASNRATGIPARFSGSGSGTDFTLTISSLEPEDFAVYYCQQRSNWPTFGQGTKVEIK

SEQ ID NO: 605 - protein, 117 aa, Artificial Sequence
  Description of Artificial Sequence: Synthetic polypeptide
  3G10[PD-L1] variable heavy Chain
QVQLVQSGAEVKKPGASVKVSCKASGYTFTDYGFSWVRQAPGQGLEWMGWITAYNGNTNYAQKLQGRVTMTTDTSTSTVYMELRSLRSDDTAVYYCARDYFYGMDVWGQGTTVTVSS

SEQ ID NO: 606 - protein, 107 aa, Artificial Sequence
  Description of Artificial Sequence: Synthetic polypeptide
  3G10[PD-L1] variable light Chain
EIVLTQSPATLSLSPGERATLSCRASQSVSSYLVWYQQKPGQAPRLLIYDASNRATGIPARFSGSGSGTDFTLTISSLEPEDFAVYYCQQRSNWPRTFGQGTKVEIK

SEQ ID NO: 607 - protein, 118 aa, Artificial Sequence
  Description of Artificial Sequence: Synthetic polypeptide
  10A5[PD-L1] variable heavy Chain
QVQLVQSGAEVKKPGASVKVSCKASGYTFTSYDVHWVRQAPGQRLEWMGWLHADTGITKFSQKFQGRVTITRDTSASTAYMELSSLRSEDTAVYYCARERIQLWFDYWGQGTLVTVSS

SEQ ID NO: 608 - protein, 107 aa, Artificial Sequence
  Description of Artificial Sequence: Synthetic polypeptide
  10A5[PD-L1] variable light Chain
DIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIK

SEQ ID NO: 609 - protein, 114 aa, Artificial Sequence
  Description of Artificial Sequence: Synthetic polypeptide
  h3D10 Var 1[PD-L1] variable heavy Chain
QVQLVQSGAEVKKPGASVKVSCKASGYTFPDYYMNWVRQAPGQGLEWMGDIDPNYGGTNYAQKFQGRVTMTRDTSISTAYMELSRLRSDDTAVYYCARGALTDWGQGTMVTVSS

SEQ ID NO: 610 - protein, 106 aa, Artificial Sequence
  Description of Artificial Sequence: Synthetic polypeptide
  h3D10 Var 1[PD-L1] variable light Chain
EIVLTQSPATLSLSPGERATLSCRASSSVSYIYWFQQKPGQAPRLLIYAAFNRATGIPARFSGSGSGTDYTLTISSLEPEDFAVYYCQQWSNNPLTFGQGTKVEIK

SEQ ID NO: 611 - protein, 114 aa, Artificial Sequence
  Description of Artificial Sequence: Synthetic polypeptide
  h3D10 Var 2[PD-L1] variable heavy Chain
QVQLVQSGAEVKKPGASVKVSCKASGYTFPDYYMNWVRQAPGQSLEWMGDIDPNYGGTNYNQKFQGRVTMTRDTSISTAYMELSRLRSDDTAVYYCARGALTDWGQGTMVTVSS

SEQ ID NO: 612 - protein, 106 aa, Artificial Sequence
  Description of Artificial Sequence: Synthetic polypeptide
  h3D10 Var 2[PD-L1] variable light Chain
EIVLTQSPATLSLSPGERATLSCRASSSVSYIYWFQQKPGQSPRPLIYAAFNRATGIPARFSGSGSGTDYTLTISSLEPEDFAVYYCQQWSNNPLTFGQGTKVEIK

SEQ ID NO: 613 - protein, 114 aa, Artificial Sequence; identical to SEQ ID NO: 611
  Description of Artificial Sequence: Synthetic polypeptide
  h3D10 Var 3[PD-L1] variable heavy Chain

SEQ ID NO: 614 - protein, 106 aa, Artificial Sequence
  Description of Artificial Sequence: Synthetic polypeptide
  h3D10 Var 3[PD-L1] variable light Chain
QIVLTQSPATLSLSPGERATLSCRASSSVSYIYWFQQKPGQSPRPLIYATFNLASGIPARFSGSGSGTSYTLTISRLEPEDFAVYYCQQWSNNPLTFGQGTKVEIK

SEQ ID NO: 615 - protein, 114 aa, Artificial Sequence
  Description of Artificial Sequence: Synthetic polypeptide
  h3D10 Var 4[PD-L1] variable heavy Chain
EVQLVQSGAEVKKPGASVKVSCKASGYTFPDYYMNWVRQAPGQSLEWMGDIDPNYGGTNYNQKFQGRVTMTVDRSSSTAYMELSRLRSDDTAVYYCARGALTDWGQGTMVTVSS

SEQ ID NO: 616 - protein, 106 aa, Artificial Sequence; identical to SEQ ID NO: 612
  Description of Artificial Sequence: Synthetic polypeptide
  h3D10 Var 4[PD-L1] variable light Chain

SEQ ID NO: 617 - protein, 114 aa, Artificial Sequence; identical to SEQ ID NO: 615
  Description of Artificial Sequence: Synthetic polypeptide
  h3D10 Var 5[PD-L1] variable heavy Chain

SEQ ID NO: 618 - protein, 106 aa, Artificial Sequence; identical to SEQ ID NO: 614
  Description of Artificial Sequence: Synthetic polypeptide
  h3D10 Var 5[PD-L1] variable light Chain

SEQ ID NO: 619 - protein, 114 aa, Artificial Sequence
  Description of Artificial Sequence: Synthetic polypeptide
  h3D10 Var 6[PD-L1] variable heavy Chain
EVQLVESGGGLVQPGRSLRLSCTASGYTFPDYYMNWVRQAPGKGLEWVGDIDPNYGGTTYAASVKGRFTISVDRSKSIAYLQMSSLKTEDTAVYYCTRGALTDWGQGTMVTVSS

SEQ ID NO: 620 - protein, 106 aa, Artificial Sequence
  Description of Artificial Sequence: Synthetic polypeptide
  h3D10 Var 6[PD-L1] variable light Chain
DIQLTQSPSSLSASVGDRVTITCRASSGVSYIYWFQQKPGKAPKLLIYAAFNLASGVPSRFSGSGSGTEYTLTISSLQPEDFATYYCQQWSNNPLTFGQGTKVEIK

SEQ ID NO: 621 - protein, 114 aa, Artificial Sequence
  Description of Artificial Sequence: Synthetic polypeptide
  h3D10 Var 7[PD-L1] variable heavy Chain
EVQLVESGGGLVQPGRSLRLSCTASGYTFPDYYMNWVRQAPGKGLEWVGDIDPNYGGTTYNASVKGRFTISVDRSKSIAYLQMSSLKTEDTAVYYCARGALTDWGQGTMVTVSS

SEQ ID NO: 622 - protein, 106 aa, Artificial Sequence
  Description of Artificial Sequence: Synthetic polypeptide
  h3D10 Var 7[PD-L1] variable light Chain
DIQLTQSPSSLSASVGDRVTITCRASSGVSYIYWFQQKPGKAPKPLIYAAFNLASGVPSRFSGSGSGTEYTLTISSLQPEDFATYYCQQWSNNPLTFGQGTKVEIK

SEQ ID NO: 623 - protein, 114 aa, Artificial Sequence; identical to SEQ ID NO: 621
  Description of Artificial Sequence: Synthetic polypeptide
  h3D10 Var 8[PD-L1] variable heavy Chain

SEQ ID NO: 624 - protein, 106 aa, Artificial Sequence
  Description of Artificial Sequence: Synthetic polypeptide
  h3D10 Var 8[PD-L1] variable light Chain
DIQLTQSPSILSASVGDRVTITCRASSSVSYIYWFQQKPGKAPKPLIYATFNLASGVPSRFSGSGSGTSYTLTISSLQPEDFATYYCQQWSNNPLTFGQGTKVEIK

SEQ ID NO: 625 - protein, 114 aa, Artificial Sequence
  Description of Artificial Sequence: Synthetic polypeptide
  h3D10 Var 9[PD-L1] variable heavy Chain
EVQLVESGGGLVQPGRSLRLSCTASGYTFPDYYMNWVRQAPGKGLEWVGDIDPNYGGTTYNQSVKGRFTISVDRSKSIAYLQMSSLKTEDTAVYYCARGALTDWGQGTMVTVSS

SEQ ID NO: 626 - protein, 106 aa, Artificial Sequence; identical to SEQ ID NO: 622
  Description of Artificial Sequence: Synthetic polypeptide
  h3D10 Var 9[PD-L1] variable light Chain

SEQ ID NO: 627 - protein, 114 aa, Artificial Sequence; identical to SEQ ID NO: 625
  Description of Artificial Sequence: Synthetic polypeptide
  h3D10 Var 10[PD-L1] variable heavy Chain

SEQ ID NO: 628 - protein, 106 aa, Artificial Sequence; identical to SEQ ID NO: 624
  Description of Artificial Sequence: Synthetic polypeptide
  h3D10 Var 10[PD-L1] variable light Chain

SEQ ID NO: 629 - protein, 114 aa, Artificial Sequence; identical to SEQ ID NO: 619
  Description of Artificial Sequence: Synthetic polypeptide
  h3D10 Var 11[PD-L1] variable heavy Chain

SEQ ID NO: 630 - protein, 106 aa, Artificial Sequence; identical to SEQ ID NO: 610
  Description of Artificial Sequence: Synthetic polypeptide
  h3D10 Var 11[PD-L1] variable light Chain

SEQ ID NO: 631 - protein, 114 aa, Artificial Sequence; identical to SEQ ID NO: 609
  Description of Artificial Sequence: Synthetic polypeptide
  h3D10 Var 12[PD-L1] variable heavy Chain

SEQ ID NO: 632 - protein, 106 aa, Artificial Sequence; identical to SEQ ID NO: 620
  Description of Artificial Sequence: Synthetic polypeptide
  h3D10 Var 12[PD-L1] variable light Chain

SEQ ID NO: 633 - protein, 114 aa, Artificial Sequence; identical to SEQ ID NO: 625
  Description of Artificial Sequence: Synthetic polypeptide
  h3D10 Var 13[PD-L1] variable heavy Chain

SEQ ID NO: 634 - protein, 106 aa, Artificial Sequence; identical to SEQ ID NO: 614
  Description of Artificial Sequence: Synthetic polypeptide
  h3D10 Var 13[PD-L1] variable light Chain

SEQ ID NO: 635 - protein, 114 aa, Artificial Sequence; identical to SEQ ID NO: 615
  Description of Artificial Sequence: Synthetic polypeptide
  h3D10 Var 14[PD-L1] variable heavy Chain

SEQ ID NO: 636 - protein, 106 aa, Artificial Sequence; identical to SEQ ID NO: 624
  Description of Artificial Sequence: Synthetic polypeptide
  h3D10 Var 14[PD-L1] variable light Chain

SEQ ID NO: 637 - protein, 123 aa, Artificial Sequence
  Description of Artificial Sequence: Synthetic polypeptide
  Antibody A[PD-L1] variable heavy Chain
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARSPDYSPYYYYGMDVWGQGTTVTVSS

SEQ ID NO: 638 - protein, 111 aa, Artificial Sequence
  Description of Artificial Sequence: Synthetic polypeptide
  Antibody A[PD-L1] variable light Chain
QSVLTQPPSASGTPGQRVTISCSGSSSNIGSNTVNWYQQLPGTAPKLLIYGNSNRPSGVPDRFSGSKSGTSASLAISGLQSEDEADYYCQSYDSSLSGSVFGGGIKLTVLG

SEQ ID NO: 639 - protein, 116 aa, Artificial Sequence
  Description of Artificial Sequence: Synthetic polypeptide
  C5H9v2[PD-L1] variable heavy Chain
EVQLLESGGGLVQPGGSLRLSCAASGFTFSSYAMSWVRQAPGKGLEWVSSIWRNGIVTVYADSVKGRFTISRDNSKNTLYLQMNSLRAEDTAVYYCAKWSAAFDYWGQGTLVTVSS

SEQ ID NO: 640 - protein, 107 aa, Artificial Sequence
  Description of Artificial Sequence: Synthetic polypeptide
  C5H9v2[PD-L1] variable light Chain
DIQMTQSPSSLSASVGDRVTITCRASQSISSYLNWYQQKPGKAPKLLIYAASSLQSGVPSRFSGSGSGTDFTLTISSLQPEDFATYYCQQDNGYPSTFGGGTKVEIK

SEQ ID NO: 641 - protein, 115 aa, Artificial Sequence
  Description of Artificial Sequence: Synthetic polypeptide
  humanized 29E.2A3[PD-L1] variable heavy Chain
EVQLVQSGAEVKKPGASVKMSCKASGYTFTSYVMHWVKQAPGQRLEWIGYVNPFNDGTKYNEMFKGRATLTSDKSTSTAYMELSSLRSEDTAVYYCARQAWGYPWGQGTLVTVSS

SEQ ID NO: 642 - protein, 111 aa, Artificial Sequence
  Description of Artificial Sequence: Synthetic polypeptide
  humanized 29E.2A3[PD-L1] variable light Chain
DIVLTQSPATLSLSPGERATLSCRATESVEYYGTSLVQWYQQKPGQPPKLLIYAASSVDSGVPSRFSGSGSGTDFTLTINSLEAEDAATYFCQQSRRVPYTFGQGTKLEIK

SEQ ID NO: 643 - protein, 121 aa, Artificial Sequence
  Description of Artificial Sequence: Synthetic polypeptide
  1B9[PD-L1] variable heavy Chain
DVQLQESGPGLVKPSQSLSLTCTVTGYSITSDHAWNWIRQVPGNKLEWMGYITYRGSTTYSPSLKSRISITRDTSKNQFFLQLNSVTTEDTATYYCARSMITTGYYVMDYWGQGTSVTVSS

SEQ ID NO: 644 - protein, 107 aa, Artificial Sequence
  Description of Artificial Sequence: Synthetic polypeptide
  1B9[PD-L1] variable light Chain
DIVMTQSHKFMSTSLGDRVTITCKASQDVGISVVWYQQKPGQSPKLLIYWASTRHTGVPDRFTGSGSGTDFTLTINNVQSEDLADYFCQQYSSYPLTVGAGTKLELK

SEQ ID NO: 645 - protein, 121 aa, Artificial Sequence
  Description of Artificial Sequence: Synthetic polypeptide
  4H1[PD-L1] variable heavy Chain
DVQLQESGPGLVKPSQSLSLTCTVTDYSITSDYAWTWIRQFPGNKLEWMGYITYRGTTRYNPSLTSRISFTRDTSKNQLFLQLNSVTTEDTGTYCCARSMITTGYYAMDYWGQGTSVTVSS

SEQ ID NO: 646 - protein, 107 aa, Artificial Sequence
  Description of Artificial Sequence: Synthetic polypeptide
  4H1[PD-L1] variable light Chain
DIVMTQSHKFMSTSVGDRVSISCKASQDVGISVAWYQQKPGQSPKLLIYWASTRHTGVPVRFTGSGSGTDFTLTISNVQSEDLADYFCQQYSSYPPTFGAGTKLELK

SEQ ID NO: 647 - protein, 120 aa, Artificial Sequence
  Description of Artificial Sequence: Synthetic polypeptide
  mAb-42[PD-L1] variable heavy Chain
QVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARGRQMFGAGIDFWGPGTLVTVSS

SEQ ID NO: 648 - protein, 112 aa, Artificial Sequence
  Description of Artificial Sequence: Synthetic polypeptide
  mAb-42[PD-L1] variable light Chain
NFMLTQPHSVSESPGKTVTISCTRSSGSIDSNYVQWYQQRPGSAPTTVIYEDNQRPSGVPDRFSGSIDSSSNSASLTISGLKTEDEADYYCQSYDSNNRHVIFGGGTKLTVL

SEQ ID NO: 649 - protein, 120 aa, Artificial Sequence
  Description of Artificial Sequence: Synthetic polypeptide
  BAP058-03[PD-L1] variable heavy Chain
EVQLVQSGAEVKKPGATVKISCKVSGYTFTSYWMYWVRQATGQGLEWMGRIDPNSGSTKYNEKFKNRVTITADKSTSTAYMELSSLRSEDTAVYYCARDYRKGLYAMDYWGQGTTVTVSS

SEQ ID NO: 650 - protein, 107 aa, Artificial Sequence
  Description of Artificial Sequence: Synthetic polypeptide
  BAP058-03[PD-L1] variable light Chain
EIVLTQSPDFQSVTPKEKVTITCKASQDVGTAVAWYLQKPGQSPQLLIYWASTRHTGVPDRFSGSGSGTDFTLKISRVEAEDVGVYYCQQYNSYPLTFGQGTKVEIK

SEQ ID NO: 651 - protein, 120 aa, Artificial Sequence
  Description of Artificial Sequence: Synthetic polypeptide
  BAP058-04[PD-L1] variable heavy Chain
EVQLVQSGAEVKKPGESLRISCKGSGYTFTSYWMYWVRQAPGQGLEWMGRIDPNSGSTKYNEKFKNRVTISVDTSKNQFSLKLSSVTAADTAVYYCARDYRKGLYAMDYWGQGTTVTVSS

SEQ ID NO: 652 - protein, 107 aa, Artificial Sequence
  Description of Artificial Sequence: Synthetic polypeptide
  BAP058-04[PD-L1] variable light Chain
EIVLTQSPDFQSVTPKEKVTITCKASQDVGTAVAWYLQKPGQSPQLLIYWASTRHTGVPSRFSGSGSGTDFTFTISSLQPEDIATYYCQQYNSYPLTFGQGTKVEIK

SEQ ID NO: 653 - protein, 120 aa, Artificial Sequence
  Description of Artificial Sequence: Synthetic polypeptide
  BAP058-06[PD-L1] variable heavy Chain
EVQLVQSGAEVKKPGESLRISCKGSGYTFTSYWMYWIRQPPGKGLEWIGRIDPNSGSTKYNEKFKNRVTITADKSTSTAYMELSSLRSEDTAVYYCARDYRKGLYAMDYWGQGTTVTVSS

SEQ ID NO: 654 - protein, 107 aa, Artificial Sequence; identical to SEQ ID NO: 652
  Description of Artificial Sequence: Synthetic polypeptide
  BAP058-06[PD-L1] variable light Chain

SEQ ID NO: 655 - protein, 120 aa, Artificial Sequence
  Description of Artificial Sequence: Synthetic polypeptide
  BAP058-07[PD-L1] variable heavy Chain
QVQLVQSGAEVKKPGASVKVSCKASGYTFTSYWMYWIRQSPSRGLEWLGRIDPNSGSTKYNEKFKNRFTISRDDSKNTAYLQMNSLKTEDTAVYYCARDYRKGLYAMDYWGQGTTVTVSS

SEQ ID NO: 656 - protein, 107 aa, Artificial Sequence
  Description of Artificial Sequence: Synthetic polypeptide
  BAP058-07[PD-L1] variable light Chain
EIVLTQSPATLSLSPGERATLSCKASQDVGTAVAWYLQKPGQSPQLLIYWASTRHTGIPPRFSGSGYGTDFTLTINNIESEDAAYYFCQQYNSYPLTFGQGTKVEIK

SEQ ID NO: 657 - protein, 120 aa, Artificial Sequence; identical to SEQ ID NO: 649
  Description of Artificial Sequence: Synthetic polypeptide
  BAP058-11[PD-L1] variable heavy Chain

SEQ ID NO: 658 - protein, 107 aa, Artificial Sequence
  Description of Artificial Sequence: Synthetic polypeptide
  BAP058-11[PD-L1] variable light Chain
DVVMTQSPLSLPVTLGQPASISCKASQDVGTAVAWYQQKPGQAPRLLIYWASTRHTGVPSRFSGSGSGTEFTLTISSLQPDDFATYYCQQYNSYPLTFGQGTKVEIK

SEQ ID NO: 659 - protein, 120 aa, Artificial Sequence
  Description of Artificial Sequence: Synthetic polypeptide
  BAP058-13[PD-L1] variable heavy Chain
EVQLVQSGAEVKKPGATVKISCKVSGYTFTSYWMYWVRQARGQRLEWIGRIDPNSGSTKYNEKFKNRFTISRDNSKNTLYLQMNSLRAEDTAVYYCARDYRKGLYAMDYWGQGTTVTVSS

SEQ ID NO: 660 - protein, 107 aa, Artificial Sequence
  Description of Artificial Sequence: Synthetic polypeptide
  BAP058-13[PD-L1] variable light Chain
AIQLTQSPSSLSASVGDRVTITCKASQDVGTAVAWYLQKPGQSPQLLIYWASTRHTGVPSRFSGSGSGTDFTFTISSLEAEDAATYYCQQYNSYPLTFGQGTKVEIK

SEQ ID NO: 661 - protein, 121 aa, Artificial Sequence
  Description of Artificial Sequence: Synthetic polypeptide
  H6[PD-L1] variable heavy Chain
QMQLVQSGAEVKKPGSSVKVSCKASGGTFSSYAISWVRQAPGQGLEWMGGIIPIFGTANYAQKFQGRVTITADESTSTAYMELSSLRSEDTAVYYCARGNIVATITPLDYWGQGTLVTVSS

SEQ ID NO: 662 - protein, 108 aa, Artificial Sequence
  Description of Artificial Sequence: Synthetic polypeptide
  H6[PD-L1] variable light Chain
SYELMQPPSVSVAPGKTATIACGGENIGRKTVHWYQQKPGQAPVLVIYYDSDRPSGIPERFSGSNSGNTATLTISRVEAGDEADYYCQVWDSSSDHRIFGGGTKLTVL

SEQ ID NO: 663 - protein, 121 aa, Artificial Sequence
  Description of Artificial Sequence: Synthetic polypeptide
  RC5[PD-L1] variable heavy Chain
EVQLLESGGGVVQPGGSLRLSCAASGFTFSSYWMSWVRQAPGKGLEWVANIKQDGSEKYYVDSVKGRFTISRDNSKNTVSLQMNSLRAEDTAVYYCAKDRYYNFPLGMDVWGQGTTVTVSS

SEQ ID NO: 664 - protein, 107 aa, Artificial Sequence
  Description of Artificial Sequence: Synthetic polypeptide
  RC5[PD-L1] variable light Chain
AIRMTQSPSSLSASVGDRVTITCRASQSISSYLNWYQQKPGKAPKLLIYTTSSLKSGVPSRFSGSGSGTDFTLTISRLQPEDFATYYCQQSYSSTWTFGRGTKVEIK

SEQ ID NO: 665 - protein, 123 aa, Artificial Sequence
  Description of Artificial Sequence: Synthetic polypeptide
  SH1A1Q[PD-L1] variable heavy Chain
EVQLVQSGAEVKKPGSSVKVSCKASGGTFSSYAISWVRQAPGQGLEWMGGIIPIFGTANYAQKFQGRVTITADKSTSTAYMELSSLRSEDTAVYYCAREGTIYDSSGYSFDYWGQGTLVTVSS

SEQ ID NO: 666 - protein, 110 aa, Artificial Sequence
  Description of Artificial Sequence: Synthetic polypeptide
  SH1A1Q[PD-L1] variable light Chain
QSVLTQPPSVSAAPGQKVTISCSGNNSNIANNYVSWYQQLPGTAPKLLIYDNNYRPSGIPDRFSGSKSGTSATLDITGLQTGDEADYYCGVWDGSLTTGVFGGGTKLTVL

SEQ ID NO: 667 - protein, 118 aa, Artificial Sequence
  Description of Artificial Sequence: Synthetic polypeptide
  SH1B3[PD-L1] variable heavy Chain
QVQLVESGGGVVQPGRSLRLSCAASGFTFSSYAMHWVRQAPGKGLEWVAVISFDGSNKYYADSVRGRFTISRDNSKNTLYLQMNSLRTEDTAVYYCARGWLDRDIDYWGQGTLVTVSS

SEQ ID NO: 668 - protein, 110 aa, Artificial Sequence
  Description of Artificial Sequence: Synthetic polypeptide
  SH1B3[PD-L1] variable light Chain
LPVLTQPASVSGSPGQSITISCTGTTSDIGGYDYVSWYQQHPGKAPKLMIYDVSKRPSGVSNRFSGSKSGNTASLTISGLQAEDEADYYCSSYTSSSTHVFGTGTKLTVL

SEQ ID NO: 669 - protein, 118 aa, Artificial Sequence
  Description of Artificial Sequence: Synthetic polypeptide
  SH1D1[PD-L1] variable heavy Chain
EVQLVESGGGVVQPGRSLRLSCAASGFTFSSYAMHWVRQAPGKGLEWVAVISFDGSNKYYADSVRGRFTISRDNSKNTLYLQMNSLRTEDTAVYYCARGWLDRDIDYWGQGTLVTVSS

SEQ ID NO: 670 - protein, 111 aa, Artificial Sequence
  Description of Artificial Sequence: Synthetic polypeptide
  SH1D1[PD-L1] variable light Chain
QSALTQPASVSGSPGQSITISCTGTSSDVGGYNYVSWYQQHPGKAPKLMIYDVSNRPSGVSNRFSGSKSGNTASLTISGLQAEDEADYYCSSYRSSTLGPVFGGGTKLTVL

SEQ ID NO: 671 - protein, 118 aa, Artificial Sequence; identical to SEQ ID NO: 667
  Description of Artificial Sequence: Synthetic polypeptide
  SH1D2[PD-L1] variable heavy Chain

SEQ ID NO: 672 - protein, 110 aa, Artificial Sequence
  Description of Artificial Sequence: Synthetic polypeptide
  SH1D2[PD-L1] variable light Chain
QAGLTQPPSVSEAPRQRVTISCSGSSSNIGNNAVNWYQQLPGKAPKLLIYYDDLLPSGVSDRFSGSKSGTSASLAISGLQSEDEADYYCAAWDDSLNGYVFGTGTKLTVL

SEQ ID NO: 673 - protein, 118 aa, Artificial Sequence; identical to SEQ ID NO: 669
  Description of Artificial Sequence: Synthetic polypeptide
  SH1D12[PD-L1] variable heavy Chain

SEQ ID NO: 674 - protein, 110 aa, Artificial Sequence
  Description of Artificial Sequence: Synthetic polypeptide
  SH1D12[PD-L1] variable light Chain
QSALTQPRSVSGSPGQSVTISCTGTSSDVGGYNYVSWYQQHPGKAPKLMIYDVSKRPSGVPDRFSGSKSGNTASLTISGLQAEDEADYYCSSYTSSTTHVFGTGTKVTVL

SEQ ID NO: 675 - protein, 118 aa, Artificial Sequence; identical to SEQ ID NO: 669
  Description of Artificial Sequence: Synthetic polypeptide
  SH1E1[PD-L1] variable heavy Chain

SEQ ID NO: 676 - protein, 110 aa, Artificial Sequence
  Description of Artificial Sequence: Synthetic polypeptide
  SH1E1[PD-L1] variable light Chain
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSVWVFGGGTQLTVL

SEQ ID NO: 677 - protein, 118 aa, Artificial Sequence; identical to SEQ ID NO: 667
  Description of Artificial Sequence: Synthetic polypeptide
  SH1G9[PD-L1] variable heavy Chain

SEQ ID NO: 678 - protein, 112 aa, Artificial Sequence
  Description of Artificial Sequence: Synthetic polypeptide
  SH1G9[PD-L1] variable light Chain
QSVLTQPASVSGSPGQSITISCTGTSSDVGGYNYVSWYQQHPGRAPRLMIYDVSNRPSGVSNRFSGSKSGNTASLTISGLQAEDEGDYYCSSYTSGGTLGPVFGGGTKLTVL

SEQ ID NO: 679 - protein, 120 aa, Artificial Sequence
  Description of Artificial Sequence: Synthetic polypeptide
  SH1E6[PD-L1] variable heavy Chain
QVQLVQSGAEVKKPGSSVKVSCKASGGTFSRYGVHWVRQAPGQGLEWMGRLIPIVSMTNYAQKFQDRVSITTDKSTGTAYMELRSLTSEDTALYYCASVGQQLPWVFFAWGQGTLVTVSS

SEQ ID NO: 680 - protein, 110 aa, Artificial Sequence
  Description of Artificial Sequence: Synthetic polypeptide
  SH1E6[PD-L1] variable light Chain
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAVVFGGGTKLTVL

SEQ ID NO: 681 - protein, 118 aa, Artificial Sequence
  Description of Artificial Sequence: Synthetic polypeptide
  SH1A2[PD-L1] variable heavy Chain
QMQLVQSGGGVVQPGRSLRLSCAASGFTFSSYAMHWVRQAPGKGLEWVAVISFDGSNKYYADSVRGRFTISRDNSKNTLYLQMNSLRTEDTAVYYCARGWLDRDIDYWGQGTLVTVSS

SEQ ID NO: 682 - protein, 110 aa, Artificial Sequence
  Description of Artificial Sequence: Synthetic polypeptide
  SH1A2[PD-L1] variable light Chain
QSVVTQPPSVSAAPGQKVTISCSGSSSNIGNNYVSWYQQVPGTAPKLLIYDNNKRPSGIPDRFSGSNSDTSATLGITGLQTGDEADYYCGTWDSSLSAWVFGGGTKLTVL

SEQ ID NO: 683 - protein, 118 aa, Artificial Sequence
  Description of Artificial Sequence: Synthetic polypeptide
  SH1B1[PD-L1] variable heavy Chain
QVQLVQSGGGVVQPGRSLRLSCAASGFTFSSYAMHWVRQAPGKGLEWVAVISFDGSNKYYADSVRGRFTISRDNSKNTLYLQMNSLRTEDTAVYYCARGWLDRDIDYWGQGTLVTVSS

SEQ ID NO: 684 - protein, 112 aa, Artificial Sequence
  Description of Artificial Sequence: Synthetic polypeptide
  SH1B1[PD-L1] variable light Chain
QSVVTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAGSVVFGGGTKLTVL

SEQ ID NO: 685 - protein, 121 aa, Artificial Sequence
  Description of Artificial Sequence: Synthetic polypeptide
  H6B1L[PD-L1] variable heavy Chain
QMQLVQSGAEVKKPGSSVKVSCKASGGTFSSYAYSWVRQAPGQGLEWMGGIIPSFGTANYAQKFQGRVTITADESTSTAYMELSSLRSEDTAVYYCARGPIVATITPLDYWGQGTLVTVSS

SEQ ID NO: 686 - protein, 108 aa, Artificial Sequence
  Description of Artificial Sequence: Synthetic polypeptide
  H6B1L[PD-L1] variable light Chain
SYELMQPPSVSVAPGKTATIACGGENIGRKTVHWYQQKPGQAPVLVIYYDSDRPSGIPERFSGSNSGNTATLTISRVEAGDEADYYCLVWDSSSDHRIFGGGTKLTVL

SEQ ID NO: 687 - protein, 121 aa, Artificial Sequence
  Description of Artificial Sequence: Synthetic polypeptide
  H6A1[PD-L1] variable heavy Chain
QMQLVQSGAEVKKPGSSVKVSCKASGGTFSSYAYSWVRQAPGQGLEWMGGIIPIFGTANYAQKFQGRVTITADESTSTAYMELSSLRSEDTAVYYCARGPIVATITPLDYWGQGTLVTVSS

SEQ ID NO: 688 - protein, 108 aa, Artificial Sequence; identical to SEQ ID NO: 662
  Description of Artificial Sequence: Synthetic polypeptide
  H6A1[PD-L1] variable light Chain

SEQ ID NO: 689 - protein, 121 aa, Artificial Sequence; identical to SEQ ID NO: 685
  Description of Artificial Sequence: Synthetic polypeptide
  H6B1[PD-L1] variable heavy Chain

SEQ ID NO: 690 - protein, 108 aa, Artificial Sequence; identical to SEQ ID NO: 662
  Description of Artificial Sequence: Synthetic polypeptide
  H6B1[PD-L1] variable light Chain

SEQ ID NO: 691 - protein, 121 aa, Artificial Sequence
  Description of Artificial Sequence: Synthetic polypeptide
  H6B2[PD-L1] variable heavy Chain
QMQLVQSGAEVKKPGSSVKVSCKASGGTFSSYAISWVRQAPGQGLEWMGGIIPAFGTANYAQKFQGRVTITADESTSTAYMELSSLRSEDTAVYYCARGPIVATITPLDYWGQGTLVTVSS

SEQ ID NO: 692 - protein, 108 aa, Artificial Sequence; identical to SEQ ID NO: 662
  Description of Artificial Sequence: Synthetic polypeptide
  H6B2[PD-L1] variable light Chain

SEQ ID NO: 693 - protein, 118 aa, Artificial Sequence
  Description of Artificial Sequence: Synthetic polypeptide
  G12[PD-L1] variable heavy Chain
EVQLVQSGAEVKKPGASVKVSCKASGYTFTGYYMHWVRQAPGQGLEWMGWINPNSDNTGSAQKFQGRVFMTKTTSLNTAYMELSGLRSEDTAIYYCARERSSGYFDFWGQGTLVTVSS

SEQ ID NO: 694 - protein, 107 aa, Artificial Sequence
  Description of Artificial Sequence: Synthetic polypeptide
  G12[PD-L1] variable light Chain
DIVMTQSPSSLSASVGDRVTITCRASQSISSYLNWYQQKPGKAPKLLIYAASSLQSGVPSRFSGSGSGTDFTLTISSLQPEDFATYYCQQSYSTPITFGQGTRLEIK

SEQ ID NO: 695 - protein, 118 aa, Artificial Sequence
  Description of Artificial Sequence: Synthetic polypeptide
  RSA1[PD-L1] variable heavy Chain
EVQLVQSGGGLVQPGGSLRLSCAASGFTFSSYSMNWVRQAPGKGLEWVSYISSSSSTIYYADSVKGRFTISRDNAKNSLYLQMNSLRDEDTAVYYCARGDYYYGMDVWGQGTTVTVSS

SEQ ID NO: 696 - protein, 108 aa, Artificial Sequence
  Description of Artificial Sequence: Synthetic polypeptide
  RSA1[PD-L1] variable light Chain
NIQMTQSPSSVSASVGDRVTITCRASQDISRWLAWYQQKPGKAPKLLIYAASSLQSGVPSRFSGSGSGTDFALTISSLQPEDFATYYCQQADSFFSITFGQGTRLEIK

SEQ ID NO: 697 - protein, 120 aa, Artificial Sequence
  Description of Artificial Sequence: Synthetic polypeptide
  RA3[PD-L1] variable heavy Chain
QMQLVQSGAEVKKPGSSVKVSCKASGGTFSRYGVHWVRQAPGQGLEWMGRLIPIVSMTNYAQKFQDRVSITTDKSTGTAYMELRSLTSEDTALYYCASVGQQLPWVFFAWGQGTLVTVSS

SEQ ID NO: 698 - protein, 107 aa, Artificial Sequence
  Description of Artificial Sequence: Synthetic polypeptide
  RA3[PD-L1] variable light Chain
DIQMTQSPSSLSASVGDRVTITCQASQDISNYLNWYQQKPGKAPKLLIYDASTLQSGVPSRFSGSGSGTDFTLTISSLQPEDFATYYCQQSYSSHWTFGQGTKVEIK

SEQ ID NO: 699 - protein, 119 aa, Artificial Sequence
  Description of Artificial Sequence: Synthetic polypeptide
  SH1E2[PD-L1] variable heavy Chain
EVQLVESGAEVKKPGSSVKVSCKASGGTFSSYAISWVRQAPGQGLEWMGGIIPIFGTANYAQKFQGRVTITADESTSTAYMELSSLRSEDTAVYYCARAPYYYYYMDVWGQGTTVTVSS

SEQ ID NO: 700 - protein, 109 aa, Artificial Sequence
  Description of Artificial Sequence: Synthetic polypeptide
  SH1E2[PD-L1] variable light Chain
QSALTQPASVSGSLGQSVTISCTGSSSDVGSYNLVSWYQQHPGKAPNLMIYDVSKRSGVSNRFSGSKSGNTASLTISGLQAEDEADYYCSSYTGISTVVFGGGTKLTVL

SEQ ID NO: 701 - protein, 120 aa, Artificial Sequence; identical to SEQ ID NO: 679
  Description of Artificial Sequence: Synthetic polypeptide
  SH1E4[PD-L1] variable heavy Chain

SEQ ID NO: 702 - protein, 112 aa, Artificial Sequence
  Description of Artificial Sequence: Synthetic polypeptide
  SH1E4[PD-L1] variable light Chain
QSVLTQPPSASGSPGQSVTISCTGTSSDIGGYDSVSWYQQHPGKAPKLMIYDVSKRPSGVSNRFSGSKSGNTASLTISGLQAEDEADYYCSSYTSSSIFFYVFGTGTKVTVL

SEQ ID NO: 703 - protein, 121 aa, Artificial Sequence
  Description of Artificial Sequence: Synthetic polypeptide
  SH1B11[PD-L1] variable heavy Chain
QVQLVQSGSELKKPGSSVKVSCKASGYSFSGYYIHWVRQAPGQGLEWMGWIDPNSGVTNYVRRFQGRVTMTRDTSLSTAYMELSGLTADDTAVYYCARDENLWQFGYLDYWGQGTLVTVSS

SEQ ID NO: 704 - protein, 107 aa, Artificial Sequence
  Description of Artificial Sequence: Synthetic polypeptide
  SH1B11[PD-L1] variable light Chain
DIVMTQSPSSLSASIGDRVTITCRASQRISAYVNWYQQKPGKAPKVLIYAASSLRSGVPSRFSGSGSGTDFTLTISSLQPEDFATYYCQQTYSSPWTFGQGTKVEIK

SEQ ID NO: 705 - protein, 119 aa, Artificial Sequence
  Description of Artificial Sequence: Synthetic polypeptide
  SH1C8[PD-L1] variable heavy Chain
EVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARGQWLVTELDYWGQGTLVTVSS

SEQ ID NO: 706 - protein, 111 aa, Artificial Sequence
  Description of Artificial Sequence: Synthetic polypeptide
  SH1C8[PD-L1] variable light Chain
QSVVTQPPSVSAAPGQKVTISCSGSSSDIGNHYVSWYQQLPGTAPKLLIYDNNQRPSGIPDRFSGSKSGTSATLAITGLQTGDEADYYCGTWDNSLSPHLLFGGGTKLTVL

SEQ ID NO: 707 - protein, 123 aa, Artificial Sequence
  Description of Artificial Sequence: Synthetic polypeptide
  H1H9364P2[PD-L1] variable heavy Chain
EVQLVESGGGLVQPGRSLRLSCAASGFTFDDYALHWVRQAPGKGLEWVSGISWTGGTIDYADSVKGRFTISRDNAKNSLYLQMSSLRTEDTAIYYCTRDIRGNWKYGGWFDPWGQGTLVTVSS

SEQ ID NO: 708 - protein, 108 aa, Artificial Sequence
  Description of Artificial Sequence: Synthetic polypeptide
  H1H9364P2[PD-L1] variable light Chain
DIQMTQSPSSLSASVGDRVTITCRASQSISSYLNWYQQKPGKAPKLLIYAASSLQSGVPSRFSGSGSGTDFTLTISSLQPEDFATYYCQQSYSTPPITFGQGTRLEIK

SEQ ID NO: 709 - protein, 120 aa, Artificial Sequence
  Description of Artificial Sequence: Synthetic polypeptide
  H1H9373P2[PD-L1] variable heavy Chain
QVQLVQSGTEVKKPGASVKVSCKASGYTFTAYYMHWVRQAPGQGLDWMGWISPNSGFTNYAQKFQGRVTMTRDTSINTFYMELSGLRSDDTAVYYCAREGSTHHNSFDPWGQGTLVTVSS

SEQ ID NO: 710 - protein, 108 aa, Artificial Sequence; identical to SEQ ID NO: 708
  Description of Artificial Sequence: Synthetic polypeptide
  H1H9373P2[PD-L1] variable light Chain

SEQ ID NO: 711 - protein, 120 aa, Artificial Sequence
  Description of Artificial Sequence: Synthetic polypeptide
  H1H8314N[PD-L1] variable heavy Chain
EVQLVESGGGVVRPGGSLRLSCAASGFTFDDYGMTWVRQAPGRGLEWVSGIHWHGKRTGYADSVKGRFTISRDNAKKSLYLQMNSLKGEDTALYHCVRGGMSTGDWFDPWGQGTLVIVSS

SEQ ID NO: 712 - protein, 108 aa, Artificial Sequence
  Description of Artificial Sequence: Synthetic polypeptide
  H1H8314N[PD-L1] variable light Chain
DIQMTQSPSSLSASLGDRVTITCRASQSINSYLNWYQQKPGKAPKLLIYVASSLQSGVPSRFSGSGSGTEFTLTISNLQPEDFATYYCQQSYSTPPITFGQGTRLEIK

SEQ ID NO: 713 - protein, 119 aa, Artificial Sequence
  Description of Artificial Sequence: Synthetic polypeptide
  PDL1.3.1[PD-L1] variable heavy Chain
EVQLQQSGTELVKPGASVKLSCTTSGFNIQDTYMHWVKQRPEQGLEWIGWIDPANGNTKYDPKFQGKATIIADTSSNTAYLQLRGLTSEDTAVYYCARSGVSTAHFDYWGQGTTLTVSS

SEQ ID NO: 714 - protein, 106 aa, Artificial Sequence
  Description of Artificial Sequence: Synthetic polypeptide
  PDL1.3.1[PD-L1] variable light Chain
QIVLSQSPAILSASPGEKVTMTCRASSSVSFMHWYQQKPGSSPKPWIYATSNLASGVPTRFSGSGSGTSYSLTLSRVEAEDAATYYCQQWSSYPRTFGGGTKLEIK

SEQ ID NO: 715 - protein, 329 aa, Artificial Sequence
  Description of Artificial Sequence: Synthetic polypeptide
  Chain 1
ASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 716 - protein, 231 aa, Artificial Sequence; identical to SEQ ID NO: 22
  Description of Artificial Sequence: Synthetic polypeptide
  Chain 2

SEQ ID NO: 717 - protein, 329 aa, Artificial Sequence
  Description of Artificial Sequence: Synthetic polypeptide
  Chain 1
ASTKGPSVFPLAPSSKSTSGGTAALGCLVKDYFPEPVTVSWNSGALTSGVHTFPAVLQSSGLYSLSSVVTVPSSSLGTQTYICNVNHKPSDTKVDKKVEPKSCDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 718 - protein, 231 aa, Artificial Sequence; identical to SEQ ID NO: 21
  Description of Artificial Sequence: Synthetic polypeptide
  Chain 2

SEQ ID NO: 719 - protein, 329 aa, Artificial Sequence
  Description of Artificial Sequence: Synthetic polypeptide
  Chain 2
ASTKGPSVFPLAPSSKSTSGGTAALGCLVKDYFPEPVTVSWNSGALTSGVHTFPAVLQSSGLYSLSSVVTVPSSSLGTKTYTCNVNHKPSNTKVDKKVERKSCDKTHTCPRCPAPPVAGPSVFLFPPKPKDTLMISRTPEVTCVVVDVKHEDPEVKFKWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 720 - protein, 107 aa, Artificial Sequence [sequence omitted]

SEQ ID NO: 721 - protein, 106 aa, Artificial Sequence
  Description of Artificial Sequence: Synthetic polypeptide
  Constant Light Chain - Lambda
GQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 722 - protein, 769 aa, Artificial Sequence; identical to SEQ ID NO: 51
  Description of Artificial Sequence: Synthetic polypeptide
  Chain 1 - human_IL12p40_(GGGGS)5-human_IL12p35_(GGGGS)2_ (single-chain)_Fc(216)_IgG1_pI(-)_Isosteric_A_C220S/PVA_/ S267K/L368D/K370S

SEQ ID NO: 723 - protein, 446 aa, Artificial Sequence
  Description of Artificial Sequence: Synthetic polypeptide
  Chain 2 - 1C11[PD-1]_H3_IgG1_PVA_/S267K/S364K/E357Q
QIQLVQSGSELKKPGASVKVSCKASGYTFTHYGMNWVRQAPGQGLEWMGWINTYTGEPTYADGFTGRFVFSLDTSVSTAYLQISSLKAEDTAVYFCARDYYGSSPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 724 - protein, 219 aa, Artificial Sequence; identical to SEQ ID NO: 590
  Description of Artificial Sequence: Synthetic polypeptide
  Chain 3 - 1C11[PD-1]_L3

SEQ ID NO: 725 - protein, 448 aa, Artificial Sequence
  Description of Artificial Sequence: Synthetic polypeptide
  Chain 2 - MAB A[PD-1]_H1_IgG1_PVA_/S267K/S364K/E357Q
QVQLQESGPGLVKPSQTLSLTCTVSGHSITSDYAWNWIRQPPGKKLEWIGYISYSGYTTYNPSLKSRVTISRDTSKNQFSLKLSSVTAADTAVYFCARDLDYGPWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 726 - protein, 214 aa, Artificial Sequence; identical to SEQ ID NO: 592
  Description of Artificial Sequence: Synthetic polypeptide
  Chain 3 - MAB A[PD-1]_L1

SEQ ID NO: 727 - protein, 448 aa, Artificial Sequence
  Description of Artificial Sequence: Synthetic polypeptide
  Chain 2 - mAb C[PD-1]_H1_IgG1_PVA_/S267K/S364K/E357Q
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLVWSPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 728 - protein, 220 aa, Artificial Sequence; identical to SEQ ID NO: 596
  Description of Artificial Sequence: Synthetic polypeptide
  Chain 3 - mAb C[PD-1]_L1

SEQ ID NO: 729 - protein, 446 aa, Artificial Sequence
  Description of Artificial Sequence: Synthetic polypeptide
  Chain 2 - mAb B[PD-1]_H1_IgG1_PVA_/S267K/S364K/E357Q
QVQLVQSGAEVKKPGASVKVSCKASGYTFTNFYIHWVRQAPGQSIEWMGSIYPNYGDTAYNQKFQGRVTMTVDKSISTAYMELSRLRSDDTAVYYCARGYSYAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 730 - protein, 214 aa, Artificial Sequence; identical to SEQ ID NO: 594
  Description of Artificial Sequence: Synthetic polypeptide
  Chain 3 - mAb B[PD-1]_L1

SEQ ID NO: 731 - protein, 15 aa, Artificial Sequence
  Description of Artificial Sequence: Synthetic peptide
GKPGSGKPGSGKPGS

SEQ ID NO: 732 - protein, 220 aa, Artificial Sequence
  Description of Artificial Sequence: Synthetic polypeptide
  Chain 3 - mAb C[PD-1]_L1.1
DIVMTQSPDSLAVSLGERATINCKSSQSLLHSGNQKNYLTWYQQKPGQPPKLLIYWASTRESGVPDRFTGSGSGTDFTLTISSLQAEDVAVYYCQNDYSYPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 733 - protein, 769 aa, Artificial Sequence
  Description of Artificial Sequence: Synthetic polypeptide
  Chain 1 - human_IL12p40_E32Q/D34N/E59K/K99E_(GGGGS)5-human_ IL12p35_(GGGGS)2_(single-chain)_Fc(216)_IgG1_pI(-)_Isosteric _A_C220S/PVA_/S267K/L368D/K370S
IWELKKDVYVVELDWYPDAPGEMVVLTCDTPQENGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 734 - protein, 20 aa, Artificial Sequence
  Description of Artificial Sequence: Synthetic peptide
GKPGSGKPGSGKPGSGKPGS

SEQ ID NO: 735 - protein, 769 aa, Artificial Sequence; identical to SEQ ID NO: 353
  Description of Artificial Sequence: Synthetic polypeptide
  Chain 1 - human_IL12p40_E59K/K99E_(GGGGS)5-human_IL12p35_ (GGGGS)2_(single-chain)_Fc(216)_IgG1_pI(-)_Isosteric_A_ C220S/PVA_/S267K/L368D/K370S

SEQ ID NO: 736 - protein, 769 aa, Artificial Sequence
  Description of Artificial Sequence: Synthetic polypeptide
  Chain 1 - human_IL12p40_(GGGGS)5-human_IL12p35_(GGGGS)2_ (single-chain)_Fc(216)_IgG1_pI(-)_Isosteric_A_C220S/PVA_/ S267K/L368D/K370S/M428L/N434S
IWELKKDVYVVELDWYPDAPGEMVVLTCDTPEEDGITWTLDQSSEVLGSGKTLTIQVKEFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 737 - protein, 448 aa, Artificial Sequence
  Description of Artificial Sequence: Synthetic polypeptide
  Chain 2 - mAb C[PD-1]_H1_IgG1_PVA_/S267K/S364K/E357Q/M428L/N434S
EVQLVESGGGLVQPGGSLRLSCAASGFTFSSFGMHWVRQAPGKGLEWVSYISSGSSIIYYADSVKGRFTISRDNAKNSLYLQMNSLRAEDTAVYYCARGGRLVWSPDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 738 - protein, 769 aa, Artificial Sequence
  Description of Artificial Sequence: Synthetic polypeptide
  Chain 1 - human_IL12p40_E32Q/D34N/E59K/K99E_(GGGGS)5-human_ IL12p35_(GGGGS)2_(single-chain)_Fc(216)_IgG1_pI(-)_Isosteric_A_ C220S/PVA_/S267K/L368D/K370S/M428L/N434S
IWELKKDVYVVELDWYPDAPGEMVVLTCDTPQENGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 739 - protein, 769 aa, Artificial Sequence
  Description of Artificial Sequence: Synthetic polypeptide
  Chain 1 - human_IL12p40_E59K/K99E_(GGGGS)5-human_IL12p35_ (GGGGS)2_(single-chain)_Fc(216)_IgG1_pI(-)_Isosteric_A_C220S/ PVA_/S267K/L368D/K370S/M428L/N434S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 740 - protein, 769 aa, Artificial Sequence
  Description of Artificial Sequence: Synthetic polypeptide
  Chain 1 - human_IL12p40_E59K/K99Y_(GGGGS)5-human_IL12p35_ (GGGGS)2_(single-chain)_Fc(216)_IgG1_pI(-)_Isosteric_A_C220S /PVA_/S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQYEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 741 - protein, 769 aa, Artificial Sequence
  Description of Artificial Sequence: Synthetic polypeptide
  Chain 1 - human_IL12p40_D18K/E59K/K99E_(GGGGS)5-human_IL12p35_ (GGGGS)2_(single-chain)_Fc(216)_IgG1_pI(-)_Isosteric_A_C220S/ PVA_/S267K/L368D/K370S
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 742 - protein, 769 aa, Artificial Sequence
  Description of Artificial Sequence: Synthetic polypeptide
  Chain 1 - human_IL12p40_E59K/K99E/K264E_(GGGGS)5-human_IL12p35_ (GGGGS)2_(single-chain)_Fc(216)_IgG1_pI(-)_Isosteric_A_C220S/ PVA_/S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKEDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 743 - protein, 769 aa, Artificial Sequence
  Description of Artificial Sequence: Synthetic polypeptide
  Chain 1 - human_IL12p40_E59K/K99E/K264E_(GGGGS)5-human_IL12p35_ (GGGGS)2_(single-chain)_Fc(216)_IgG1_pI(-)_Isosteric_A_C220S/ PVA_/S267K/L368D/K370S/M428L/N434S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKEDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 744 - protein, 448 aa, Artificial Sequence; identical to SEQ ID NO: 737
  Description of Artificial Sequence: Synthetic polypeptide
  Chain 2 - mAb C[PD-1]_H1_IgG1_C220S/PVA_/S267K/S364K/E357Q/M428L /N434S

SEQ ID NO: 745 - protein, 769 aa, Artificial Sequence
  Description of Artificial Sequence: Synthetic polypeptide
  Chain 1 - human_IL12p40_E59K/K99Y_(GGGGS)5-human_IL12p35_ (GGGGS)2_(single-chain)_Fc(216)_IgG1_pI(-)_Isosteric_A_C220S /PVA_/S267K/L368D/K370S/M428L/N434S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQYEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 746 - protein, 769 aa, Artificial Sequence
  Description of Artificial Sequence: Synthetic polypeptide
  Chain 1 - human_IL12p40_D18K/E59K/K99E/K264E_(GGGGS)5-human _IL12p35_(GGGGS)2_(single-chain)_Fc(216)_IgG1_pI(-)_Isosteric _A_C220S/PVA_/S267K/L368D/K370S
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKEDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 747 - protein, 769 aa, Artificial Sequence
  Description of Artificial Sequence: Synthetic polypeptide
  Chain 1 - human_IL12p40_D18K/E59K/K99E/C252S_(GGGGS)5-human _IL12p35_(GGGGS)2_(single-chain)_Fc(216)_IgG1_pI(-)_Isosteric _A_C220S/PVA_/S267K/L368D/K370S
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 748 - protein, 20 aa, Artificial Sequence
  Description of Artificial Sequence: Synthetic peptide
GKGKSGKGKSGKGKSGKGKS

SEQ ID NO: 749 - protein, 769 aa, Artificial Sequence
  Description of Artificial Sequence: Synthetic polypeptide
  Chain 1 - human_IL12p40_D18K/E59K/K99E/C252S/K264E_(GGGGS)5- human_IL12p35_(GGGGS)2_(single-chain)_Fc(216)_IgG1_pI(-)_ Isosteric_A_C220S/PVA_/S267K/L368D/K370S
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 750 - protein, 769 aa, Artificial Sequence
  Description of Artificial Sequence: Synthetic polypeptide
  Chain 1 - human_IL12p40_E59K/K99E/C252S/K264E_(GGGGS)5-human_ IL12p35_(GGGGS)2_(single-chain)_Fc(216)_IgG1_pI(-)_Isosteric_A _C220S/PVA_/S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 751 - protein, 447 aa, Artificial Sequence
  Description of Artificial Sequence: Synthetic polypeptide
  Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 752 - protein, 214 aa, Artificial Sequence
  Description of Artificial Sequence: Synthetic polypeptide
  Chain 3 - YW243.55.S70[PD-L1]_L0
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 753 - protein, 14 aa, Artificial Sequence
  Description of Artificial Sequence: Synthetic peptide
STAGDTHLGGEDFD

SEQ ID NO: 754 - protein, 449 aa, Artificial Sequence
  Description of Artificial Sequence: Synthetic polypeptide
  Chain 2 - Numax_VH_IgG1_PVA_/S267K/S364K/E357Q
QVTLRESGPALVKPTQTLTLTCTFSGFSLSTAGMSVGWIRQPPGKALEWLADIWWDDKKHYNPSLKDRLTISKDTSKNQVVLKVTNMDPADTATYYCARDMIFNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 755 - protein, 213 aa, Artificial Sequence
  Description of Artificial Sequence: Synthetic polypeptide
  Chain 3 - Numax LC
DIQMTQSPSTLSASVGDRVTITCSASSRVGYMHWYQQKPGKAPKLLIYDTSKLASGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 756 - protein, 15 aa, Artificial Sequence
  Description of Artificial Sequence: Synthetic peptide
GEGGSGEGGSGEGGS

SEQ ID NO: 757 - protein, 15 aa, Artificial Sequence
  Description of Artificial Sequence: Synthetic peptide
GGEGSGGEGSGGEGS

SEQ ID NO: 758 - protein, 449 aa, Artificial Sequence
  Description of Artificial Sequence: Synthetic polypeptide
  Chain 2 - Numax_VH_IgG1_PVA_/S267K/S364K/E357Q/M428L/N434S
QVTLRESGPALVKPTQTLTLTCTFSGFSLSTAGMSVGWIRQPPGKALEWLADIWWDDKKHYNPSLKDRLTISKDTSKNQVVLKVTNMDPADTATYYCARDMIFNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 759 - protein, 449 aa, Artificial Sequence; identical to SEQ ID NO: 758
  Description of Artificial Sequence: Synthetic polypeptide
  Chain 2 - Numax_VH_IgG1_C220S/PVA_/S267K/S364K/E357Q/M428L/N434S

SEQ ID NO: 760 - protein, 15 aa, Artificial Sequence
  Description of Artificial Sequence: Synthetic peptide
GGGESGGGESGGGES

SEQ ID NO: 761 - protein, 15 aa, Artificial Sequence
  Description of Artificial Sequence: Synthetic peptide
GEGESGEGESGEGES

SEQ ID NO: 762 - protein, 15 aa, Artificial Sequence
  Description of Artificial Sequence: Synthetic peptide
GGGESGGEGSGEGGS

SEQ ID NO: 763 - protein, 306 aa, Artificial Sequence
  Description of Artificial Sequence: Synthetic polypeptide
  IL12p40(E59K/C252S)
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCS

SEQ ID NO: 764 - protein, 306 aa, Artificial Sequence
  Description of Artificial Sequence: Synthetic polypeptide
  IL12p40(E59K/N200Q)
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 765 - protein, 306 aa, Artificial Sequence
  Description of Artificial Sequence: Synthetic polypeptide
  IL12p40(E59K/K99Y/N200Q)
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQYEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 766 - protein, 306 aa, Artificial Sequence
  Description of Artificial Sequence: Synthetic polypeptide
  IL12p40(E59K/K99E/N200Q)
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 767 - protein, 306 aa, Artificial Sequence
  Description of Artificial Sequence: Synthetic polypeptide
  IL12p40(D18K/E59K/K99E/N200Q)
IEWLKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCS

SEQ ID NO: 768 - protein, 306 aa, Artificial Sequence
  Description of Artificial Sequence: Synthetic polypeptide
  IL12p40(E59K/K99E/N200Q/K264E)
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKEDRVFTDKTSATVICRKNASISVRAQDRYYSSSWSEWASVPCS

SEQ ID NO: 769 - protein, 306 aa, Artificial Sequence
  Description of Artificial Sequence: Synthetic polypeptide
  IL12p40(D18K/E59K/K99E/N200Q/K264E)
IEWLKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKEDRVFTDKTSATVICRKNASISVRAQDRYYSSSWSEWASVPCS

SEQ ID NO: 770 - protein, 306 aa, Artificial Sequence
  Description of Artificial Sequence: Synthetic polypeptide
  IL12p40(E59K/N200Q/C252S)
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCS

SEQ ID NO: 771 - protein, 306 aa, Artificial Sequence
  Description of Artificial Sequence: Synthetic polypeptide
  IL12p40(E59K/K99Y/N200Q/C252S)
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQYEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCS

SEQ ID NO: 772 - protein, 306 aa, Artificial Sequence
  Description of Artificial Sequence: Synthetic polypeptide
  IL12p40(E59K/K99E/N200Q/C252S)
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCS

SEQ ID NO: 773 - protein, 306 aa, Artificial Sequence
  Description of Artificial Sequence: Synthetic polypeptide
  IL12p40(D18K/E59K/K99E/N200Q/C252S)
IEWLKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCS

SEQ ID NO: 774 - protein, 306 aa, Artificial Sequence
  Description of Artificial Sequence: Synthetic polypeptide
  IL12p40(D18K/E59K/K99E/N200Q/C252S/K264E)
IEWLKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCS

SEQ ID NO: 775 - protein, 547 aa, Artificial Sequence
  Description of Artificial Sequence: Synthetic polypeptide
  Chain 1 - human_IL12p40(E59K/C252S)_(GGGGS)2_Fc(216)_IgG1_pI(-)_ Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 776 - protein, 438 aa, Artificial Sequence; identical to SEQ ID NO: 48
  Description of Artificial Sequence: Synthetic polypeptide
  Chain 2 - IL12p35_(GGGGS)2_Fc(216)_IgG1_C220S/PVA_/S267K/S364K/ E357Q

SEQ ID NO: 777 - protein, 547 aa, Artificial Sequence
  Description of Artificial Sequence: Synthetic polypeptide
  Chain 1 - human_IL12p40(E59K/N200Q)_(GGGGS)2_Fc(216)_IgG1_pI(-)_ Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 778 - protein, 547 aa, Artificial Sequence
  Description of Artificial Sequence: Synthetic polypeptide
  Chain 1 - human_IL12p40(E59K/K99Y/N200Q)_(GGGGS)2_Fc(216)_IgG1_ pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQYEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 779 - protein, 547 aa, Artificial Sequence
  Description of Artificial Sequence: Synthetic polypeptide
  Chain 1 - human_IL12p40(E59K/K99E/N200Q)_(GGGGS)2_Fc(216)_IgG1_ pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 780 - protein, 547 aa, Artificial Sequence
  Description of Artificial Sequence: Synthetic polypeptide
  Chain 1 - human_IL12p40(D18K/E59K/K99E/N200Q)_(GGGGS)2_Fc(216)_ IgG1_pI(-)_Isosteric_A_C220S/PVA_/S267K/L368D/K370S
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 781 - protein, 438 aa, Artificial Sequence; identical to SEQ ID NO: 48
  Description of Artificial Sequence: Synthetic polypeptide
  Chain 2 - human_IL12p35_(GGGGS)2_Fc(216)_IgG1_C220S/PVA_/S267K/ S364K/E357Q

SEQ ID NO: 782 - protein, 547 aa, Artificial Sequence
  Description of Artificial Sequence: Synthetic polypeptide
  Chain 1 - human_IL12p40(E59K/K99E/N200Q/K264E)_(GGGGS)2_Fc(216) _IgG1_pI(-)_Isosteric_A_C220S/PVA_/S267K/L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKEDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 783 - protein, 547 aa, Artificial Sequence
  Description of Artificial Sequence: Synthetic polypeptide
  Chain 1 - human_IL12p40(D18K/E59K/K99E/N200Q/K264E)_(GGGGS)2_ Fc(216)_IgG1_pI(-)_Isosteric_A_C220S/PVA_/S267K/L368D/K370S
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKEDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 784 - protein, 547 aa, Artificial Sequence
  Description of Artificial Sequence: Synthetic polypeptide
  Chain 1 - human_IL12p40(E59K/N200Q/C252S)_(GGGGS)2_Fc(216)_IgG1_ pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 785 - protein, 547 aa, Artificial Sequence
  Description of Artificial Sequence: Synthetic polypeptide
  Chain 1 - human_IL12p40(E59K/K99Y/N200Q/C252S)_(GGGGS)2_Fc(216)_ IgG1_pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQYEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 786 - protein, 547 aa, Artificial Sequence
  Description of Artificial Sequence: Synthetic polypeptide
  Chain 1 - human_IL12p40(E59K/K99E/N200Q/C252S)_(GGGGS)2_Fc(216)_ IgG1_pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 787 - protein, 547 aa, Artificial Sequence
  Description of Artificial Sequence: Synthetic polypeptide
  Chain 1 - human_IL12p40(D18K/E59K/K99E/N200Q/C252S)_(GGGGS)2_ Fc(216)_IgG1_pI(-)_Isosteric_A_C220S/PVA_/S267K/L368D/K370S
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 788 - protein, 20 aa, Artificial Sequence
  Description of Artificial Sequence: Synthetic peptide
GEGESGEGESGEGESGEGES

SEQ ID NO: 789 - protein, 547 aa, Artificial Sequence
  Description of Artificial Sequence: Synthetic polypeptide
  Chain 1 - human_IL12p40(D18K/E59K/K99E/N200Q/C252S/K264E)_ (GGGGS)2_Fc(216)_IgG1_pI(-)_Isosteric_A_C220S/PVA_/S267K/ L368D/K370S
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 790 - protein, 547 aa, Artificial Sequence
  Description of Artificial Sequence: Synthetic polypeptide
  Chain 1 - human_IL12p40_E59K/K99E/N103Q/N113Q/N281Q/C252S/K264E_ (GGGGS)2_Fc(216)_IgG1_pI(-)_Isosteric_A_C220S/PVA_/S267K/ L368D/K370S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKQKTFLRCEAKQYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKQASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 791 - protein, 547 aa, Artificial Sequence
  Description of Artificial Sequence: Synthetic polypeptide
  Chain 1 - human_IL12p40(E59K)_(GGGGS)2_Fc(216)_IgG1_pI(-)_ Isosteric_A_C220S/PVA_/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 792 - protein, 438 aa, Artificial Sequence; identical to SEQ ID NO: 319
  Description of Artificial Sequence: Synthetic polypeptide
  Chain 2 - human_IL12p35_(GGGGS)2_IgG1_PVA_/S267K/S364K/E357Q /M428L/N434S

SEQ ID NO: 793 - protein, 547 aa, Artificial Sequence
  Description of Artificial Sequence: Synthetic polypeptide
  Chain 1 - human_IL12p40(D18K/E59K/K99E/K264E)_(GGGGS)2_Fc(216)_ IgG1_pI(-)_Isosteric_A_C220S/PVA_/S267K/L368D/K370S/M428L/N434S
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKEDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 794 - protein, 438 aa, Artificial Sequence; identical to SEQ ID NO: 319
  Description of Artificial Sequence: Synthetic polypeptide
  Chain 2 - human_IL12p35_(GGGGS)2_Fc(216)_IgG1_C220S/PVA_/S267K/ S364K/E357Q/M428L/N434S

SEQ ID NO: 795 - protein, 547 aa, Artificial Sequence
  Description of Artificial Sequence: Synthetic polypeptide
  Chain 1 - human_IL12p40(E59K/C252S)_(GGGGS)2_Fc(216)_IgG1_pI(-)_ Isosteric_A_C220S/PVA_/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 796 - protein, 19 aa, Artificial Sequence
  Description of Artificial Sequence: Synthetic peptide
PRGASKSGSASQTGSAPGS

SEQ ID NO: 797 - protein, 547 aa, Artificial Sequence
  Description of Artificial Sequence: Synthetic polypeptide
  Chain 1 - human_IL12p40(E59K/K99Y/C252S)_(GGGGS)2_Fc(216)_IgG1_ pI(-)_Isosteric_A_C220S/PVA_/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQYEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 798 - protein, 547 aa, Artificial Sequence
  Description of Artificial Sequence: Synthetic polypeptide
  Chain 1 - human_IL12p40(E59K/K99E/C252S)_(GGGGS)2_Fc(216)_IgG1_ pI(-)_Isosteric_A_C220S/PVA_/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 799 - protein, 547 aa, Artificial Sequence
  Description of Artificial Sequence: Synthetic polypeptide
  Chain 1 - human_IL12p40(D18K/E59K/C252S/K99E)_(GGGGS)2_Fc(216)_ IgG1_pI(-)_Isosteric_A_C220S/PVA_/S267K/L368D/K370S/M428L/N434S
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 800 - protein, 438 aa, Artificial Sequence; identical to SEQ ID NO: 319
  Description of Artificial Sequence: Synthetic polypeptide
  Chain 2 - human_IL12p35_(GGGGS)2_Fc(216)_IgG1_C220S/PVA_/S267K/ S364K/E357Q/M428L/N434S

SEQ ID NO: 801 - protein, 547 aa, Artificial Sequence
  Description of Artificial Sequence: Synthetic polypeptide
  Chain 1 - human_IL12p40(E59K/K99E/C252S/K264E)_(GGGGS)2_Fc(216)_ IgG1_pI(-)_Isosteric_A_C220S/PVA_/S267K/L368D/K370S/M428L/N434S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 802 - protein, 547 aa, Artificial Sequence
  Description of Artificial Sequence: Synthetic polypeptide
  Chain 1 - human_IL12p40(D18K/E59K/K99E/C252S/K264E)_(GGGGS)2_ Fc(216)_IgG1_pI(-)_Isosteric_A_C220S/PVA_/S267K/L368D/K370S/ M428L/N434S
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 803 - protein, 547 aa, Artificial Sequence
  Description of Artificial Sequence: Synthetic polypeptide
  Chain 1 - human_IL12p40(E59K/N200Q)_(GGGGS)2_Fc(216)_IgG1_pI(-)_ Isosteric_A_C220S/PVA_/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 804 - protein, 547 aa, Artificial Sequence
  Description of Artificial Sequence: Synthetic polypeptide
  Chain 1 - human_IL12p40(E59K/K99Y/N200Q)_(GGGGS)2_Fc(216)_IgG1_ pI(-)_Isosteric_A_C220S/PVA_/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQYEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 805 - protein, 547 aa, Artificial Sequence
  Description of Artificial Sequence: Synthetic polypeptide
  Chain 1 - human_IL12p40(E59K/K99E/N200Q)_(GGGGS)2_Fc(216)_IgG1_ pI(-)_Isosteric_A_C220S/PVA_/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 806 - protein, 566 aa, Artificial Sequence
  Description of Artificial Sequence: Synthetic polypeptide
  Chain 1 - human_IL12p40(D18K/E59K/K99E/N200Q)_(GGGGS)2_Fc(216)_ IgG1_pI(-)_Isosteric_A_C220S/PVA_/S267K/L368D/K370S/M428L/N434S
MGWSCIILFLVATATGVHSIWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 807 - protein, 547 aa, Artificial Sequence
  Description of Artificial Sequence: Synthetic polypeptide
  Chain 1 - human_IL12p40(E59K/K99E/N200Q/K264E)_(GGGGS)2_Fc(216)_ IgG1_pI(-)_Isosteric_A_C220S/PVA_/S267K/L368D/K370S/M428L/N434S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKEDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 808 - protein, 547 aa, Artificial Sequence
  Description of Artificial Sequence: Synthetic polypeptide
  Chain 1 - human_IL12p40(D18K/E59K/K99E/N200Q/K264E)_(GGGGS)2_ Fc(216)_IgG1_pI(-)_Isosteric_A_C220S/PVA_/S267K/L368D/K370S/ M428L/N434S
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKEDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 809 - protein, 547 aa, Artificial Sequence
  Description of Artificial Sequence: Synthetic polypeptide
  Chain 1 - human_IL12p40(E59K/N200Q/C252S)_(GGGGS)2_Fc(216)_ IgG1_pI(-)_Isosteric_A_C220S/PVA_/S267K/L368D/K370S/M428L/ N434S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 810 - protein, 547 aa, Artificial Sequence
  Description of Artificial Sequence: Synthetic polypeptide
  Chain 1 - human_IL12p40(E59K/K99Y/N200Q/C252S)_(GGGGS)2_Fc(216)_ IgG1_pI(-)_Isosteric_A_C220S/PVA_/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQYEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 811 - protein, 547 aa, Artificial Sequence
  Description of Artificial Sequence: Synthetic polypeptide
  Chain 1 - human_IL12p40(XXX)_(GGGGS)2_Fc(216)_IgG1_pI(-)_ Isosteric_A_C220S/PVA_/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 812 - protein, 547 aa, Artificial Sequence
  Description of Artificial Sequence: Synthetic polypeptide
  Chain 1 - human_IL12p40(D18K/E59K/K99E/N200Q/C252S)_(GGGGS)2_ Fc(216)_IgG1_pI(-)_Isosteric_A_C220S/PVA_/S267K/L368D/K370S/ M428L/N434S
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 813 - protein, 547 aa, Artificial Sequence
  Description of Artificial Sequence: Synthetic polypeptide
  Chain 1 - human_IL12p40(E59K/K99E/N200Q/C252S/K264E)_(GGGGS)2_ Fc(216)_IgG1_pI(-)_Isosteric_A_C220S/PVA_/S267K/L368D/K370S/ M428L/N434S
IWELKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 814 - protein, 547 aa, Artificial Sequence
  Description of Artificial Sequence: Synthetic polypeptide
  Chain 1 - human_IL12p40(D18K/E59K/K99E/N200Q/C252S/K264E)_ (GGGGS)2_Fc(216)_IgG1_pI(-)_Isosteric_A_C220S/PVA_/S267K/ L368D/K370S/M428L/N434S
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 815 - protein, 769 aa, Artificial Sequence
  Description of Artificial Sequence: Synthetic polypeptide
  Chain 1 - human_IL12p40(E59K)_(GGGGS)5-human_IL12p35_(GGGGS)2_ (single-chain)_Fc(216)_IgG1_pI(-)_Isosteric_A_C220S/PVA_/ S267K/L368D/K370S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 816 - protein, 19 aa, Artificial Sequence
  Description of Artificial Sequence: Synthetic peptide
GTAAAGAGAAGGAAAGAAG

SEQ ID NO: 817 - protein, 19 aa, Artificial Sequence
  Description of Artificial Sequence: Synthetic peptide
GTSGSSGSGSGGSGSGGGG

SEQ ID NO: 818 - protein, 769 aa, Artificial Sequence
  Description of Artificial Sequence: Synthetic polypeptide
  Chain 1 - human_IL12p40(E59K/K99E)_(GGGGS)5-human_IL12p35_ (GGGGS)2_(single-chain)_Fc(216)_IgG1_pI(-)_Isosteric_A_C220S /PVA_/S267K/L368D/K370S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 819 - protein, 769 aa, Artificial Sequence
  Description of Artificial Sequence: Synthetic polypeptide
  Chain 1 - human_IL12p40(E59K/C252S)_(GGGGS)5-human_IL12p35_ (GGGGS)2_(single-chain)_Fc(216)_IgG1_pI(-)_Isosteric_A_C220S /PVA_/S267K/L368D/K370S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 820 - protein, 769 aa, Artificial Sequence
  Description of Artificial Sequence: Synthetic polypeptide
  Chain 1 - human_IL12p40(E59K/K99Y/C252S)_(GGGGS)5-human_IL12p35_ (GGGGS)2_(single-chain)_Fc(216)_IgG1_pI(-)_Isosteric_A_C220S/ PVA_/S267K/L368D/K370S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQYEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 821 - protein, 769 aa, Artificial Sequence
  Description of Artificial Sequence: Synthetic polypeptide
  Chain 1 - human_IL12p40(E59K/K99E/C252S)_(GGGGS)5-human_IL12p35_ (GGGGS)2_(single-chain)_Fc(216)_IgG1_pI(-)_Isosteric_A_C220S/ PVA_/S267K/L368D/K370S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 822 - protein, 769 aa, Artificial Sequence
  Description of Artificial Sequence: Synthetic polypeptide
  Chain 1 - human_IL12p40(E59K/N200Q)_(GGGGS)5-human_IL12p35_ (GGGGS)2_(single-chain)_Fc(216)_IgG1_pI(-)_Isosteric_A_C220S /PVA_/S267K/L368D/K370S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 823 - protein, 769 aa, Artificial Sequence
  Description of Artificial Sequence: Synthetic polypeptide
  Chain 1 - human_IL12p40(E59K/K99Y/N200Q)_(GGGGS)5-human_IL12p35_ (GGGGS)2_(single-chain)_Fc(216)_IgG1_pI(-)_Isosteric_A_C220S/ PVA_/S267K/L368D/K370S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQYEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 824 - protein, 769 aa, Artificial Sequence
  Description of Artificial Sequence: Synthetic polypeptide
  Chain 1 - human_IL12p40(E59K/K99E/N200Q)_(GGGGS)5-human_IL12p35_ (GGGGS)2_(single-chain)_Fc(216)_IgG1_pI(-)_Isosteric_A_C220S/ PVA_/S267K/L368D/K370S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 825 - protein, 769 aa, Artificial Sequence
  Description of Artificial Sequence: Synthetic polypeptide
  Chain 1 - human_IL12p40(D18K/E59K/K99E/N200Q)_(GGGGS)5-human_ IL12p35_(GGGGS)2_(single-chain)_Fc(216)_IgG1_pI(-)_Isosteric_ A_C220S/PVA_/S267K/L368D/K370S
IEWLKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 826 - protein, 769 aa, Artificial Sequence
  Description of Artificial Sequence: Synthetic polypeptide
  Chain 1 - human_IL12p40(E59K/K99E/N200Q/K264E)_(GGGGS)5-human_ IL12p35_(GGGGS)2_(single-chain)_Fc(216)_IgG1_pI(-)_Isosteric_A _C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKEDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 827 - protein, 769 aa, Artificial Sequence
  Description of Artificial Sequence: Synthetic polypeptide
  Chain 1 - human_IL12p40_D18K/E59K/K99E/N200Q/K264E_(GGGGS)5 -human_IL12p35_(GGGGS)2_(single-chain)_Fc(216)_IgG1_pI(-)_ Isosteric_A_C220S/PVA_/S267K/L368D/K370S
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKEDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 828 - protein, 20 aa, Artificial Sequence
  Description of Artificial Sequence: Synthetic peptide
GKPGSGKPGSGKPGSGKPGS

SEQ ID NO: 829 - protein, 220 aa, Artificial Sequence; identical to SEQ ID NO: 732
  Description of Artificial Sequence: Synthetic polypeptide
  Chain 3 - mAb C[PD-1]_L1.1 Light Chain

SEQ ID NO: 830 - protein, 769 aa, Artificial Sequence
  Description of Artificial Sequence: Synthetic polypeptide
  Chain 1 - human_IL12p40(E59K/N200Q/C252S)_(GGGGS)5-human_ IL12p35_(GGGGS)2_(single-chain)_Fc(216)_IgG1_pI(-)_Isosteric_A_ C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 831 - protein, 769 aa, Artificial Sequence
  Description of Artificial Sequence: Synthetic polypeptide
  Chain 1 - human_IL12p40(E59K/K99Y/N200Q/C252S)_(GGGGS)5-human_ IL12p35_(GGGGS)2_(single-chain)_Fc(216)_IgG1_pI(-)_Isosteric_ A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQYEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 832 - protein, 769 aa, Artificial Sequence
  Description of Artificial Sequence: Synthetic polypeptide
  Chain 1 - human_IL12p40(E59K/K99E/N200Q/C252S)_(GGGGS)5-human_ IL12p35_(GGGGS)2_(single-chain)_Fc(216)_IgG1_pI(-)_Isosteric_ A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 833 - protein, 4 aa, Artificial Sequence
  Description of Artificial Sequence: Synthetic peptide
EPKS

SEQ ID NO: 834 - protein, 769 aa, Artificial Sequence
  Description of Artificial Sequence: Synthetic polypeptide
  Chain 1 - human_IL12p40(D18K/E59K/K99E/N200Q/C252S)_(GGGGS)5 -human_IL12p35_(GGGGS)2_(single-chain)_Fc(216)_IgG1_pI(-)_ Isosteric_A_C220S/PVA_/S267K/L368D/K370S
IEWLKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 835 - protein, 769 aa, Artificial Sequence
  Description of Artificial Sequence: Synthetic polypeptide
  Chain 1 - human_IL12p40(E59K/K99E/N200Q/C252S/K264E)_(GGGGS)5- human_IL12p35_(GGGGS)2_(single-chain)_Fc(216)_IgG1_pI(-)_ Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 836 - protein, 769 aa, Artificial Sequence
  Description of Artificial Sequence: Synthetic polypeptide
  Chain 1 - human_IL12p40_D18K/E59K/K99E/N200Q/C252S/K264E_ (GGGGS)5-human_IL12p35_(GGGGS)2_(single-chain)_Fc(216)_IgG1_ pI(-)_Isosteric_A_C220S/PVA_/S267K/L368D/K370S
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 837 - protein, 769 aa, Artificial Sequence
  Description of Artificial Sequence: Synthetic polypeptide
  Chain 1 - human_IL12p40(E59K)_(GGGGS)5-human_IL12p35_(GGGGS)2_ (single-chain)_Fc(216)_IgG1_pI(-)_Isosteric_A_C220S/PVA_/S267K/ L368D/K370S/M428L/N434S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 838 - protein, 5 aa, Artificial Sequence
  Description of Artificial Sequence: Synthetic peptide
GSGGS

SEQ ID NO: 839 - protein, 769 aa, Artificial Sequence
  Description of Artificial Sequence: Synthetic polypeptide
  Chain 1 - human_IL12p40(E59K/K99E)_(GGGGS)5-human_IL12p35_ (GGGGS)2_(single-chain)_Fc(216)_IgG1_pI(-)_Isosteric_A_C220S /PVA_/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 840 - protein, 4 aa, Artificial Sequence
  Description of Artificial Sequence: Synthetic peptide
GGGS

SEQ ID NO: 841 - protein, 5 aa, Artificial Sequence
  Description of Artificial Sequence: Synthetic peptide
GAGGA

SEQ ID NO: 842 - protein, 769 aa, Artificial Sequence
  Description of Artificial Sequence: Synthetic polypeptide
  Chain 1 - human_IL12p40(D18K/E59K/K99E)_(GGGGS)5-human_IL12p35_ (GGGGS)2_(single-chain)_Fc(216)_IgG1_pI(-)_Isosteric_A_C220S/ PVA_/S267K/L368D/K370S/M428L/N434S
IEWLKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 843 - protein, 4 aa, Artificial Sequence
  Description of Artificial Sequence: Synthetic peptide
GGGA

SEQ ID NO: 844 - protein, 20 aa, Artificial Sequence
  Description of Artificial Sequence: Synthetic peptide
GKPGSGKPGSGKPGSGKPGS

SEQ ID NO: 845 - protein, 769 aa, Artificial Sequence
  Description of Artificial Sequence: Synthetic polypeptide
  Chain 1 - human_IL12p40_D18K/E59K/K99E/K264E_(GGGGS)5-human_ IL12p35_(GGGGS)2_(single-chain)_Fc(216)_IgG1_pI(-)_Isosteric_ A_C220S/PVA_/S267K/L368D/K370S/M428L/N434S
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKEDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 846 - protein, 769 aa, Artificial Sequence
  Description of Artificial Sequence: Synthetic polypeptide
  Chain 1 - human_IL12p40(E59K/C252S)_(GGGGS)5-human_IL12p35_ (GGGGS)2_(single-chain)_Fc(216)_IgG1_pI(-)_Isosteric_A_C220S /PVA_/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 847 - protein, 769 aa, Artificial Sequence
  Description of Artificial Sequence: Synthetic polypeptide
  Chain 1 - human_IL12p40(E59K/K99Y/C252S)_(GGGGS)5-human_IL12p35_ (GGGGS)2_(single-chain)_Fc(216)_IgG1_pI(-)_Isosteric_A_C220S/PVA _/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQYEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 848 - protein, 769 aa, Artificial Sequence
  Description of Artificial Sequence: Synthetic polypeptide
  Chain 1 - human_IL12p40(E59K/K99E/C252S)_(GGGGS)5-human_IL12p35_ (GGGGS)2_(single-chain)_Fc(216)_IgG1_pI(-)_Isosteric_A_C220S/PVA _/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 849 - protein, 769 aa, Artificial Sequence
  Description of Artificial Sequence: Synthetic polypeptide
  Chain 1 - human_IL12p40(D18K/E59K/K99E/C252S)_(GGGGS)5-human_ IL12p35_(GGGGS)2_(single-chain)_Fc(216)_IgG1_pI(-)_Isosteric_ A_C220S/PVA_/S267K/L368D/K370S/M428L/N434S
IEWLKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 850 - protein, 769 aa, Artificial Sequence
  Description of Artificial Sequence: Synthetic polypeptide
  Chain 1 - human_IL12p40(E59K/K99E/C252S/K264E)_(GGGGS)5-human_ IL12p35_(GGGGS)2_(single-chain)_Fc(216)_IgG1_pI(-)_Isosteric_ A_C220S/PVA_/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 851 - protein, 769 aa, Artificial Sequence
  Description of Artificial Sequence: Synthetic polypeptide
  Chain 1 - human_IL12p40_D18K/E59K/K99E/C252S/K264E_(GGGGS)5- human_IL12p35_(GGGGS)2_(single-chain)_Fc(216)_IgG1_pI(-)_ Isosteric_A_C220S/PVA_/S267K/L368D/K370S/M428L/N434S
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 852 - protein, 769 aa, Artificial Sequence
  Description of Artificial Sequence: Synthetic polypeptide
  Chain 1 - human_IL12p40(E59K/N200Q)_(GGGGS)5-human_IL12p35_ (GGGGS)2_(single-chain)_Fc(216)_IgG1_pI(-)_Isosteric_A_C220S /PVA_/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 853 - protein, 769 aa, Artificial Sequence
  Description of Artificial Sequence: Synthetic polypeptide
  Chain 1 - human_IL12p40(E59K/K99Y/N200Q)_(GGGGS)5-human_IL12p35_ (GGGGS)2_(single-chain)_Fc(216)_IgG1_pI(-)_Isosteric_A_C220S/ PVA_/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQYEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 854 - protein, 769 aa, Artificial Sequence
  Description of Artificial Sequence: Synthetic polypeptide
  Chain 1 - human_IL12p40(E59K/K99E/N200Q)_(GGGGS)5-human_IL12p35_ (GGGGS)2_(single-chain)_Fc(216)_IgG1_pI(-)_Isosteric_A_C220S/ PVA_/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 855 - protein, 769 aa, Artificial Sequence
  Description of Artificial Sequence: Synthetic polypeptide
  Chain 1 - human_IL12p40(D18K/E59K/K99E/N200Q)_(GGGGS)5-human_ IL12p35_(GGGGS)2_(single-chain)_Fc(216)_IgG1_pI(-)_Isosteric_ A_C220S/PVA_/S267K/L368D/K370S/M428L/N434S
IEWLKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 856 - protein, 769 aa, Artificial Sequence
  Description of Artificial Sequence: Synthetic polypeptide
  Chain 1 - human_IL12p40(E59K/K99E/N200Q/K264E)_(GGGGS)5-human_ IL12p35_(GGGGS)2_(single-chain)_Fc(216)_IgG1_pI(-)_Isosteric_ A_C220S/PVA_/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKEDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 857 - protein, 769 aa, Artificial Sequence
  Description of Artificial Sequence: Synthetic polypeptide
  Chain 1 - human_IL12p40_D18K/E59K/K99E/N200Q/K264E_(GGGGS)5- human_IL12p35_(GGGGS)2_(single-chain)_Fc(216)_IgG1_pI(-)_ Isosteric_A_C220S/PVA_/S267K/L368D/K370S/M428L/N434S
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKEDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 858 - protein, 769 aa, Artificial Sequence
  Description of Artificial Sequence: Synthetic polypeptide
  Chain 1 - human_IL12p40(E59K/N200Q/C252S)_(GGGGS)5-human_ IL12p35_(GGGGS)2_(single-chain)_Fc(216)_IgG1_pI(-)_Isosteric_ A_C220S/PVA_/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQKEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 859 - protein, 769 aa, Artificial Sequence
  Description of Artificial Sequence: Synthetic polypeptide
  Chain 1 - human_IL12p40(E59K/K99Y/N200Q/C252S)_(GGGGS)5-human _IL12p35_(GGGGS)2_(single-chain)_Fc(216)_IgG1_pI(-)_Isosteric _A_C220S/PVA_/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQYEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 860 - protein, 769 aa, Artificial Sequence
  Description of Artificial Sequence: Synthetic polypeptide
  Chain 1 - human_IL12p40(E59K/K99E/N200Q/C252S)_(GGGGS)5-human_ IL12p35_(GGGGS)2_(single-chain)_Fc(216)_IgG1_pI(-)_Isosteric_ A_C220S/PVA_/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 861 - protein, 769 aa, Artificial Sequence
  Description of Artificial Sequence: Synthetic polypeptide
  Chain 1 - human_IL12p40(D18K/E59K/K99E/N200Q/C252S)_(GGGGS)5- human_IL12p35_(GGGGS)2_(single-chain)_Fc(216)_IgG1_pI(-)_ Isosteric_A_C220S/PVA_/S267K/L368D/K370S/M428L/N434S
IEWLKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 862 - protein, 769 aa, Artificial Sequence
  Description of Artificial Sequence: Synthetic polypeptide
  Chain 1 - human_IL12p40(E59K/K99E/N200Q/C252S/K264E)_(GGGGS)5- human_IL12p35_(GGGGS)2_(single-chain)_Fc(216)_IgG1_pI(-)_ Isosteric_A_C220S/PVA_/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 863 - protein, 769 aa, Artificial Sequence
  Description of Artificial Sequence: Synthetic polypeptide
  Chain 1 - human_IL12p40_D18K/E59K/K99E/N200Q/C252S/K264E_ (GGGGS)5-human_IL12p35_(GGGGS)2_(single-chain)_Fc(216)_IgG1 _pI(-)_Isosteric_A_C220S/PVA_/S267K/L368D/K370S/M428L/N434S
IWELKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 864 - protein, 447 aa, Artificial Sequence
  Description of Artificial Sequence: Synthetic polypeptide
  XENP021461 Pembrolizumab_H0L0_IgG4_S228P Light Chain
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 865 - protein, 218 aa, Artificial Sequence
  Description of Artificial Sequence: Synthetic polypeptide
EIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 866 - protein, 769 aa, Artificial Sequence; identical to SEQ ID NO: 861
  Description of Artificial Sequence: Synthetic polypeptide
  Chain 1 - human_IL12p40(D18K/E59K/K99E/N200Q/C252S)_(GGGGS)5 -human_IL12p35_(GGGGS)2_(single-chain)_Fc(216)_IgG1_pI(-)_ Isosteric_A_C220S/PVA_/S267K/L368D/K370S

SEQ ID NO: 867 - protein, 214 aa, Artificial Sequence; identical to SEQ ID NO: 752
  Description of Artificial Sequence: Synthetic polypeptide
  Chain 3 - YW243.55.S70[PD-L1]_L0

SEQ ID NO: 868 - protein, 769 aa, Artificial Sequence; identical to SEQ ID NO: 862
  Description of Artificial Sequence: Synthetic polypeptide
  Chain 1 - human_IL12p40(E59K/K99E/N200Q/C252S/K264E)_(GGGGS)5 -human_IL12p35_(GGGGS)2_(single-chain)_Fc(216)_IgG1_pI(-)_ Isosteric_A_C220S/PVA_/S267K/L368D/K370S

SEQ ID NO: 869 - protein, 447 aa, Artificial Sequence
  Description of Artificial Sequence: Synthetic polypeptide
  Chain 2 - YW243.55.S70[PD-L1]_H0_IgG1_PVA_/S267K/S364K/E357Q
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPPVAGPSVFLFPPKPKDTLMISRTPEVTCVVVDVKHEDPEVKFNWYVDGVEVHNAKTKPREEQYNSTYRVVSVLTVLHQDWLNGKEYKCKVSNKALPAPIEKTISKAKGQPREPQVYTLPPSREQMTKNQVKLTCLVKGFYPSDIAVEWESNGQPENNYKTTPPVLDSDGSFFLYSKLTVDKSRWQQGNVFSCSVLHEALHSHYTQKSLSLSPGK

SEQ ID NO: 870 - protein, 769 aa, Artificial Sequence
  Description of Artificial Sequence: Synthetic polypeptide
  Chain 1 - human_IL12p40(E59K/K99Y)_(GGGGS)5-human_IL12p35_ (GGGGS)2_(single-chain)_Fc(216)_IgG1_pI(-)_Isosteric_A_C220S /PVA_/S267K/L368D/K370S/M428L/N434S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQYEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 871 - protein, 214 aa, Artificial Sequence; identical to SEQ ID NO: 752
  Description of Artificial Sequence: Synthetic polypeptide
  Chain 3 - YW243.55.S70[PD-L1]_L0

SEQ ID NO: 872 - protein, 769 aa, Artificial Sequence
  Description of Artificial Sequence: Synthetic polypeptide
  Chain 1 - human_IL12p40(D18K/E59K/K99E/N200Q/K264E)_(GGGGS)5 -human_IL12p35_(GGGGS)2_(single-chain)_Fc(216)_IgG1_pI(-) _Isosteric_A_C220S/PVA_/S267K/L368D/K370S
IEWLKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKEDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 873 - protein, 769 aa, Artificial Sequence
  Description of Artificial Sequence: Synthetic polypeptide
  Chain 1 - human_IL12p40(D18K/E59K/K99E/N200Q/C252S/K264E)_ (GGGGS)5-human_IL12p35_(GGGGS)2_(single-chain)_Fc(216)_IgG1_pI (-)_Isosteric_A_C220S/PVA_/S267K/L368D/K370S
IEWLKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 874 - protein, 769 aa, Artificial Sequence; identical to SEQ ID NO: 837
  Description of Artificial Sequence: Synthetic polypeptide
  Chain 1 - human_IL12p40(E59K)_(GGGGS)5-human_IL12p35_(GGGGS)2 _(single-chain)_Fc(216)_IgG1_pI(-)_Isosteric_A_C220S/PVA_/ S267K/L368D/K370S

SEQ ID NO: 875 - protein, 769 aa, Artificial Sequence; identical to SEQ ID NO: 870
  Description of Artificial Sequence: Synthetic polypeptide
  Chain 1 - human_IL12p40(E59K/K99Y)_(GGGGS)5-human_IL12p35_ (GGGGS)2_(single-chain)_Fc(216)_IgG1_pI(-)_Isosteric_A_ C220S/PVA_/S267K/L368D/K370S

SEQ ID NO: 876 - protein, 769 aa, Artificial Sequence; identical to SEQ ID NO: 839
  Description of Artificial Sequence: Synthetic polypeptide
  Chain 1 - human_IL12p40(E59K/K99E)_(GGGGS)5-human_IL12p35_ (GGGGS)2_(single-chain)_Fc(216)_IgG1_pI(-)_Isosteric_A_ C220S/PVA_/S267K/L368D/K370S

SEQ ID NO: 877 - protein, 769 aa, Artificial Sequence; identical to SEQ ID NO: 842
  Description of Artificial Sequence: Synthetic polypeptide
  Chain 1 - human_IL12p40(D18K/E59K/K99E)_(GGGGS)5-human_IL12p35 _(GGGGS)2_(single-chain)_Fc(216)_IgG1_pI(-)_Isosteric_A_C220S /PVA_/S267K/L368D/K370S

SEQ ID NO: 878 - protein, 769 aa, Artificial Sequence
  Description of Artificial Sequence: Synthetic polypeptide
  Chain 1 - human_IL12p40(E59K/K99E/K264E)_(GGGGS)5-human_IL12p35 _(GGGGS)2_(single-chain)_Fc(216)_IgG1_pI(-)_Isosteric_A_C220S /PVA_/S267K/L368D/K370S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKEDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 879 - protein, 769 aa, Artificial Sequence
  Description of Artificial Sequence: Synthetic polypeptide
  Chain 1 - human_IL12p40(D18K/E59K/K99E/K264E)_(GGGGS)5-human _IL12p35_(GGGGS)2_(single-chain)_Fc(216)_IgG1_pI(-)_Isosteric _A_C220S/PVA_/S267K/L368D/K370S
IEWLKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKEDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 880 - protein, 769 aa, Artificial Sequence; identical to SEQ ID NO: 846
  Description of Artificial Sequence: Synthetic polypeptide
  Chain 1 - human_IL12p40(E59K/C252S)_(GGGGS)5-human_IL12p35_ (GGGGS)2_(single-chain)_Fc(216)_IgG1_pI(-)_Isosteric_A_ C220S/PVA_/S267K/L368D/K370S

SEQ ID NO: 881 - protein, 769 aa, Artificial Sequence; identical to SEQ ID NO: 847
  Description of Artificial Sequence: Synthetic polypeptide
  Chain 1 - human_IL12p40(E59K/K99Y/C252S)_(GGGGS)5-human_IL12p35 _(GGGGS)2_(single-chain)_Fc(216)_IgG1_pI(-)_Isosteric_A_C220S /PVA_/S267K/L368D/K370S

SEQ ID NO: 882 - protein, 769 aa, Artificial Sequence; identical to SEQ ID NO: 848
  Description of Artificial Sequence: Synthetic polypeptide
  Chain 1 - human_IL12p40(E59K/K99E/C252S)_(GGGGS)5-human _IL12p35_(GGGGS)2_(single-chain)_Fc(216)_IgG1_pI(-)_ Isosteric_A_C220S/PVA_/S267K/L368D/K370S

SEQ ID NO: 883 - protein, 769 aa, Artificial Sequence; identical to SEQ ID NO: 849
  Description of Artificial Sequence: Synthetic polypeptide
  Chain 1 - human_IL12p40(D18K/E59K/K99E/C252S)_(GGGGS)5 -human_IL12p35_(GGGGS)2_(single-chain)_Fc(216)_IgG1_ pI(-)_Isosteric_A_C220S/PVA_/S267K/L368D/K370S

SEQ ID NO: 884 - protein, 769 aa, Artificial Sequence; identical to SEQ ID NO: 850
  Description of Artificial Sequence: Synthetic polypeptide
  Chain 1 - human_IL12p40(E59K/K99E/C252S/K264E)_(GGGGS)5 -human_IL12p35_(GGGGS)2_(single-chain)_Fc(216)_IgG1_ pI(-)_Isosteric_A_C220S/PVA_/S267K/L368D/K370S

SEQ ID NO: 885 - protein, 769 aa, Artificial Sequence
  Description of Artificial Sequence: Synthetic polypeptide
  Chain 1 - human_IL12p40(D18K/E59K/K99E/C252S/K264E)_ (GGGGS)5-human_IL12p35_(GGGGS)2_(single-chain)_Fc(216) _IgG1_pI(-)_Isosteric_A_C220S/PVA_/S267K/L368D/K370S
IEWLKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 886 - protein, 769 aa, Artificial Sequence; identical to SEQ ID NO: 852
  Description of Artificial Sequence: Synthetic polypeptide
  Chain 1 - human_IL12p40(E59K/N200Q)_(GGGGS)5-human_IL12p35 _(GGGGS)2_(single-chain)_Fc(216)_IgG1_pI(-)_Isosteric_A _C220S/PVA_/S267K/L368D/K370S

SEQ ID NO: 887 - protein, 769 aa, Artificial Sequence; identical to SEQ ID NO: 853
  Description of Artificial Sequence: Synthetic polypeptide
  Chain 1 - human_IL12p40(E59K/K99Y/N200Q)_(GGGGS)5-human _IL12p35_(GGGGS)2_(single-chain)_Fc(216)_IgG1_pI(-) _Isosteric_A_C220S/PVA_/S267K/L368D/K370S

SEQ ID NO: 888 - protein, 769 aa, Artificial Sequence; identical to SEQ ID NO: 854
  Description of Artificial Sequence: Synthetic polypeptide
  Chain 1 - human_IL12p40(E59K/K99E/N200Q)_(GGGGS)5-human _IL12p35_(GGGGS)2_(single-chain)_Fc(216)_IgG1_pI(-) _Isosteric_A_C220S/PVA_/S267K/L368D/K370S

SEQ ID NO: 889 - protein, 769 aa, Artificial Sequence; identical to SEQ ID NO: 855
  Description of Artificial Sequence: Synthetic polypeptide
  Chain 1 - human_IL12p40(D18K/E59K/K99E/N200Q)_(GGGGS)5 -human_IL12p35_(GGGGS)2_(single-chain)_Fc(216)_IgG1 _pI(-)_Isosteric_A_C220S/PVA_/S267K/L368D/K370S

SEQ ID NO: 890 - protein, 769 aa, Artificial Sequence
  Description of Artificial Sequence: Synthetic polypeptide
  Chain 1 - human_IL12p40(D18K/E59K/K99E/K264E)_(GGGGS)5 -human_IL12p35_(GGGGS)2_(single-chain)_Fc(216)_IgG1_pI (-)_Isosteric_A_C220S/PVA_/S267K/L368D/K370S
IEWLKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFCVQVQGKSKREKEDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 891 - protein, 769 aa, Artificial Sequence; identical to SEQ ID NO: 856
  Description of Artificial Sequence: Synthetic polypeptide
  Chain 1 - human_IL12p40(E59K/K99E/N200Q/K264E)_(GGGGS)5 -human_IL12p35_(GGGGS)2_(single-chain)_Fc(216)_IgG1 _pI(-)_Isosteric_A_C220S/PVA_/S267K/L368D/K370S

SEQ ID NO: 892 - protein, 769 aa, Artificial Sequence
  Description of Artificial Sequence: Synthetic polypeptide
  Chain 1 - human_IL12p40(D18K/E59K/K99E/N200Q/K264E)_ (GGGGS)5-human_IL12p35_(GGGGS)2_(single-chain)_Fc(216) _IgG1_pI(-)_Isosteric_A_C220S/PVA_/S267K/L368D/K370S
IEWLKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYEQYTSSFFIRDIIKPDPPKNLQLKPLKNSRQVEVSWEYPDTWSTPHSYFSLTFCVQVQGKSKREKEDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVLHEALHSHYTQKSLSLSPGK

SEQ ID NO: 893 - protein, 769 aa, Artificial Sequence; identical to SEQ ID NO: 858
  Description of Artificial Sequence: Synthetic polypeptide
  Chain 1 - human_IL12p40(E59K/N200Q/C252S)_(GGGGS)5- human_IL12p35_(GGGGS)2_(single-chain)_Fc(216)_IgG1 _pI(-)_Isosteric_A_C220S/PVA_/S267K/L368D/K370S

SEQ ID NO: 894 - protein, 769 aa, Artificial Sequence
  Description of Artificial Sequence: Synthetic polypeptide
  Chain 1 - human_IL12p40(D18K/E59K/K99E/C252S)_(GGGGS)5 -human_IL12p35_(GGGGS)2_(single-chain)_Fc(216)_IgG1_ pI(-)_Isosteric_A_C220S/PVA_/S267K/L368D/K370S
IEWLKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKKDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 895 - protein, 769 aa, Artificial Sequence
  Description of Artificial Sequence: Synthetic polypeptide
  Chain 1 - human_IL12p40(E59K/K99E/C252S/K264E)_(GGGGS)5 -human_IL12p35_(GGGGS)2_(single-chain)_Fc(216)_IgG1_ pI(-)_Isosteric_A_C220S/PVA_/S267K/L368D/K370S
IEWLKKDVYVVELDWYPDAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 896 - protein, 769 aa, Artificial Sequence
  Description of Artificial Sequence: Synthetic polypeptide
  Chain 1 - human_IL12p40(D18K/E59K/K99E/C252S/K264E)_ (GGGGS)5-human_IL12p35_(GGGGS)2_(single-chain)_Fc(216) _IgG1_pI(-)_Isosteric_A_C220S/PVA_/S267K/L368D/K370S
IEWLKKDVYVVELDWYPKAPGEMVVLTCDTPEEDGITWTLDQSSEVLGSGKTLTIQVKKFGDAGQYTCHKGGEVLSHSLLLLHKKEDGIWSTDILKDQEEPKNKTFLRCEAKNYSGRFTCWWLTTISTDLTFSVKSSRGSSDPQGVTCGAATLSAERVRGDNKEYEYSVECQEDSACPAAEESLPIEVMVDAVHKLKYENYTSSFFIRDIIKPDPPKNLQLKPLKNSRQVEVSWEYPDTWSTPHSYFSLTFSVQVQGKSKREKEDRVFTDKTSATVICRKNASISVRAQDRYYSSSWSEWASVPCSGGGGSGGGGSGGGGSGGGGSGGGGSRNLPVATPDPGMFPCLHHSQNLLRAVSNMLQKARQTLEFYPCTSEEIDHEDITKDKTSTVEACLPLELTKNESCLNSRETSFITNGSCLASRKTSFMMALCLSSIYEDLKMYQVEFKTMNAKLLMDPKRQIFLDQNMLAVIDELMQALNFNSETVPQKSSLEEPDFYKTKIKLCILLHAFRIRAVTIDRVMSYLNASGGGGSGGGGSEPKSSDKTHTCPPCPAPPVAGPSVFLFPPKPKDTLMISRTPEVTCVVVDVKHEDPEVKFNWYVDGVEVHNAKTKPREEEYNSTYRVVSVLTVLHQDWLNGKEYKCKVSNKALPAPIEKTISKAKGQPREPQVYTLPPSREEMTKNQVSLTCDVSGFYPSDIAVEWESDGQPENNYKTTPPVLDSDGSFFLYSKLTVDKSRWEQGDVFSCSVMHEALHNHYTQKSLSLSPGK

SEQ ID NO: 897 - protein, 769 aa, Artificial Sequence; identical to SEQ ID NO: 859
  Description of Artificial Sequence: Synthetic polypeptide
  Chain 1 - human_IL12p40(E59K/K99Y/N200Q/C252S)_(GGGGS)5 -human_IL12p35_(GGGGS)2_(single-chain)_Fc(216)_IgG1 _pI(-)_Isosteric_A_C220S/PVA_/S267K/L368D/K370S

SEQ ID NO: 898 - protein, 769 aa, Artificial Sequence; identical to SEQ ID NO: 860
  Description of Artificial Sequence: Synthetic polypeptide
  Chain 1 - human_IL12p40(E59K/K99E/N200Q/C252S)_(GGGGS)5 -human_IL12p35_(GGGGS)2_(single-chain)_Fc(216)_IgG1 _pI(-)_Isosteric_A_C220S/PVA_/S267K/L368D/K370S

What is claimed is:

1. A targeted IL-12 heterodimeric Fc fusion protein comprising:
   a) a first monomer comprising, from N- to C-terminal:
      i) a first IL-12 protein domain;
      ii) a first domain linker;
      iii) a second IL-12 protein domain;
      iv) a second domain linker; and
      v) a first variant human IgG Fc domain comprising CH2-CH3; and
   b) second monomer comprising, from N- to C-terminal:
      i) an scFv domain;
      ii) a third domain linker; and
      iii) a second variant human IgG Fc domain comprising CH2-CH3;
   wherein either said first IL-12 protein domain comprises an 1L-12p35 subunit and said second IL-12 protein domain comprises an 1L-12p40 subunit, or said first IL-12 protein domain comprises an 1L-12p40 subunit and said second IL-12 protein domain comprises an 1L-12p35 subunit, wherein said first monomer binds a dimeric IL-12 receptor complex,
wherein said scFv domain comprises a variable heavy domain, an scFv linker, a variable light domain, and said scFv domain binds a target antigen, and
wherein said first and said second variant human IgG Fc domains comprise modifications promoting heterodimerization of said first and said second variant human IgG Fc domains, and
wherein said 1L-12p40 subunit is a variant 1L-12p40 subunit, and
wherein said variant 1L-12p40 subunit comprises an amino acid sequence that differs from that of SEQ ID NO:4 by virtue of an amino acid substitution at one or more amino acid residues selected from the group consisting of E59, K99, D18, K264, C252, N200, E3, D7, E12, D14, W15, P17, A19, P20, G21, E22, M23, D29, E32, E33, D34, L40, D41, Q42, S43, E45, L47, T54, 155, Q56, K58, F60, G61, D62, Q65, Y66, E73, K84, E86, D87, G88, I89, W90, D93, D97, E100, K102, N103, K104, F106, E110, N113, Y114, D129, D142, Q144, E156, R159, D161, N162, K163, D166, D170, Q172, D174, A176, C177, P178, A179, A180, E181, 5183, P185, E187, S204, F206, R208, D209, D214, N218, Q220, N226, Q229, E231, E235, T242, P243, S245, Y246, F247, S248, Q256, K258, K260, E262, D265, D270, N281, 0289, D290, R291, Y292, Y293, and E299.

2. The targeted IL-12 heterodimeric Fc fusion protein according to claim 1, wherein said scFv domain binds a target antigen selected from the group consisting of human PD-1 and human PD-L1.

3. The targeted IL-12 heterodimeric Fc fusion protein according to claim 2, wherein said scFv domain binds human PD-1 and does not compete for binding to said human PD-1 with nivolumab and/or pembrolizumab.

4. The targeted IL-12 heterodimeric Fc fusion protein according to claim 1, wherein said IL-12p35 subunit is a variant IL-12p35 subunit, and
wherein said variant IL-12p35 subunit comprises an amino acid sequence that differs from that of SEQ ID NO:2 by virtue of an amino acid substitution at one or more amino acid residues selected from the group consisting of Q20, N21, Q35, E38, S44, E45, E46, H49, K54, D55, T59, V60, E61, C63, L64, P65, E67, L68, N71, S73, C74, L75, N76, E79, N85, L89, F96, M97, L124, M125, Q130, Q135, N136, E143, Q146, N151, E153, K158, E162, E163, D165, I171, R181, I182, R183, V185, T186, D188, R189, V190, S192, Y193, N195, and A196.

5. The targeted IL-12 heterodimeric Fc fusion protein according to claim 1, wherein said modifications promoting heterodimerization of said first and said second variant human IgG Fc domains are a set of amino acid substitutions selected from the group consisting of L368D/K370S and S364K; L368D/K370S and S364K/E357L; L368D/K370S and S364K/E357Q; T411E/K360E/Q362E and D401K; L368E/K370S and S364K; K370S and S364K/E357Q; T366S/L368A/Y407V and T366W; and T366S/L368A/Y407V/Y349C and T366W/S354C, according to EU, numbering and/or wherein said first and said second variant human IgG Fc domains each comprise amino acid substitutions M428L/N434S, according to EU numbering.

6. One or more nucleic acids encoding a targeted IL-12 heterodimeric Fc fusion protein according to claim 1.

7. A host cell comprising said one or more nucleic acids of claim 6.

8. A method of making a targeted IL-12 heterodimeric Fc fusion protein, said method comprising culturing a host cell according to claim 7 under conditions whereby said targeted IL-12 heterodimeric Fc fusion protein is produced.

9. A targeted IL-12 heterodimeric Fc fusion protein comprising:
a) a first monomer comprising, from N- to C-terminal:
i) a first IL-12 protein domain;
ii) a first domain linker;
iii) a second IL-12 protein domain;
iv) a first variant human IgG Fc domain;
b) a second monomer comprising an antibody heavy chain comprising VH-CH1-hinge-CH2-CH3, wherein said CH2-CH3 is a second variant human IgG Fc domain; and
c) a third monomer comprising an antibody light chain comprising VL-CL;
wherein said VH and VL domains form an antigen binding domain that binds a target antigen;
wherein either said first IL-12 protein domain comprises an IL-12p35 subunit and said second IL-12 protein domain comprises an IL-12p40 subunit, or said first IL-12 protein domain comprises an IL-12p40 subunit and said second IL-12 protein domain comprises an IL-12p35 subunit,
wherein said first monomer binds a dimeric IL-12 receptor complex,
wherein said first and said second variant human IgG Fc domains comprise modification promoting heterodimerization of said first and second variant human IgG Fc domains, and
wherein said IL-12p40 subunit is a variant IL-12p40 subunit, and
wherein said variant IL-12p40 subunit comprises an amino acid sequence that differs from that of SEQ ID NO:4 by virtue of an amino acid substitution at one or more amino acid residues selected from the group consisting of E59, K99, D18, K264, C252, N200, E3, D7, E12, D14, W15, P17, A19, P20, G21, E22, M23, D29, E32, E33, D34, L40, D41, Q42, S43, E45, L47, T54, 155, Q56, K58, F60, G61, D62, Q65, Y66, E73, K84, E86, D87, G88, I89, W90, D93, D97, E100, K102, N103, K104, F106, E110, N113, Y114, D129, D142, Q144, E156, R159, D161, N162, K163, D166, D170, Q172, D174, A176, C177, P178, A179, A180, E181, S183, P185, E187, S204, F206, R208, D209, D214, N218, 0220, N226, Q229, E231, E235, T242, P243, S245, Y246, F247, S248, Q256, K258, K260, E262, D265, D270, N281, 0289, D290, R291, Y292, Y293, and E299.

10. The targeted IL-12 heterodimeric Fc fusion protein according to claim 9, wherein said antigen binding domain binds a target antigen selected from the group consisting of human PD-1 and human PD-L1.

11. The targeted IL-12 heterodimeric Fc fusion protein according to claim 9, wherein said antigen binding domain binds human PD-1 and does not compete for binding to said human PD-1 with nivolumab and/or pembrolizumab.

12. The targeted IL-12 heterodimeric Fc fusion protein according to claim 9, wherein said IL-12p35 subunit is a variant IL-12p35 subunit, and
wherein said variant IL-12p35 subunit comprises an amino acid sequence that differs from that of SEQ ID NO:2 by virtue of an amino acid substitution at one or more amino acid residues selected from the group consisting of Q20, N21, Q35, E38, S44, E45, E46, H49, K54, D55, T59, V60, E61, C63, L64, P65, E67, L68, N71, S73, C74, L75, N76, E79, N85, L89, F96, M97, L124, M125, Q130, Q135, N136, E143, Q146, N151, E153, K158, E162, E163, D165, I171, R181, I182, R183, V185, T186, D188, R189, V190, S192, Y193, N195, and A196.

13. The targeted IL-12 heterodimeric Fc fusion protein according to claim 9, wherein said modifications promoting heterodimerization of said first and said second variant human IgG Fc domains are a set of amino acid substitutions selected from the group consisting of L368D/K370S and S364K; L368D/K370S and S364K/E357L; L368D/K370S and S364K/E357Q; T411E/K360E/Q362E and D401K; L368E/K370S and S364K; K370S and S364K/E357Q; and T366S/L368A/Y407V and T366W, T366S/L368A/Y407V/Y349C and T366W/S354C, according to EU numbering, and/or wherein said first and said second variant human IgG Fc domains each comprise amino acid substitutions M428L/N434S, according to EU numbering.

14. One or more nucleic acids encoding a targeted IL-12 heterodimeric Fc fusion protein according to claim 9.

15. A host cell comprising said one or more nucleic acids of claim 14.

16. A method of making a targeted IL-12 heterodimeric Fc fusion protein, said method comprising culturing a host cell according to claim 15 under conditions whereby said targeted IL-12 heterodimeric Fc fusion protein is produced.

\* \* \* \* \*

UNITED STATES PATENT AND TRADEMARK OFFICE
CERTIFICATE OF CORRECTION

| | | |
|---|---|---|
| PATENT NO. | : 11,851,466 B2 | Page 1 of 1 |
| APPLICATION NO. | : 17/062458 | |
| DATED | : December 26, 2023 | |
| INVENTOR(S) | : Bernett et al. | |

It is certified that error appears in the above-identified patent and that said Letters Patent is hereby corrected as shown below:

On the Title Page:

The first or sole Notice should read --

Subject to any disclaimer, the term of this patent is extended or adjusted under 35 U.S.C. 154(b) by 201 days.

Signed and Sealed this
Twelfth Day of August, 2025

Coke Morgan Stewart
*Acting Director of the United States Patent and Trademark Office*